United States Patent 7,504,490 (NUCLEIC ACID AND AMINO ACID SEQUENCES RELATING TO APERGILLUS FUMIGATUS FOR DIAGNOSTICS AND THERAPEUTICS) - sequence listing, part 8

SEQ ID NO: 41987 - protein, 833 aa, A.fumigatus
YMPSTPVSWRCVVHRVYPPLFWTDDRLDSFATYREARERQEREEYERKNPKIQQQFADLKRSLASVSEEQWANLPEVGDLTGKNRRAKQNLRQRFYAVPDSVIASARDSTQFETTIADDGTQTDVRGGAADGTMTNFADISAARDKVLKVRLDQAARGSTADSSSGSATNIDPKGYLTSLTQSELKAGEVEIGDIKRVRVLLESVTKTNPKHAPGWIALARLEELAGRIVAARNIIAKGCELCPKSEDAWLENIRLNEGHNAKVIAANAIKNNDRSTRLWIEAMRLESDTRAKKNVLRQAILHVPQSVTIWKEAVNLEEDPADARLLLAKAVEMIPLSVELWLALARLETPENAQKVLNAARKAVPTSHEVWIAAARLQEQMGTFDKVNVMKRAVQALARENAMLKREEWIAEAEKCEEEGAILTCGAIIRETLGWGLDEDDDRKDIWMDDAKGSIARGKYETAKAIYAYALRVFVNRRSIWLAAADLERNHGSKEALWQVLEKAVEACPQSEELWLQLAKEKWQAGEIDDARRVLGRAFNQNPNNEDIWLAAVKLEADADQTDQARELLATARREAGTDRVWIKSVAFERQLGNIDEALDLVNQGLQLYPKADKLWMMKGQIYEYQNKYPQAREAYSTGTRACPKSVPLWLLASRLEEKSGAVVKARSVLDRARLAVPKSAELWTESVRVERRANNIGQAKVLMAKALQEVPTSGLLWSESIWHLEPRAQRKARSLEAIKKVENDPILFITVARIFWGERRLEKAMTWFEKAIVSDSDHGDGWAWYYKFLLQHGTEVRSSSSVSDLLQSCRTTNATPRTGKKSRRCGQVRLN

SEQ ID NO: 41988 - protein, 78 aa, A.fumigatus
ALICALHLFPGVLARIADLPRRRAGSPFWKGRSVSQPQGPSATATTIVGASYSHANILKFVISQSALSSAYELTKSNL

SEQ ID NO: 41989 - protein, 157 aa, A.fumigatus
APLEATCYQVLIVAALDPANALNLIDHAPPPKNGSPKEVEIYSSRISRINKFKRLLQTSTVSLSELRNLAWSGIPAEVRAMTWQILLGYLPTNSERRVSTLERKRKEYLDGVRQAFERSTTPSPGNPQASSTGRGRGLDEAIWHQISIDVPRTSPSY

SEQ ID NO: 41990 - protein, 159 aa, A.fumigatus
ASVEMASGRKDFLNQPAPENYVAGLGRGATGFTTRSDLGPAREGPTPEQIQAALAKRAQLLGAAPPTAYGAGREKGGREEKEEEEEDERFQDPDNEVGLFAYGQFDQEDDEADRIYKEVDEKMDKRRKARRLVHAFHSCILEMRCSSGLPPVVLDRRPT

SEQ ID NO: 41991 - protein, 133 aa, A.fumigatus
DTHSLDVANLDFARFQLRLRQTCEISFRVDVGRTPGGGISSGTPGGLIKPDLKHLITGSTNIRKVRHCAVRRASTNIRLGTVIGYGGFELSGVPCTGNNAVWYRIEALSQVLLSSSILPREVSDFRKIGPLLF

SEQ ID NO: 41992 - protein, 73 aa, A.fumigatus
LILAGALAVGCVCVSSLSTSLPSIITSNQSNRSPVSSLPLRCRLILPSSLFSPFLFLPFSFIIERNDYSSHFI

SEQ ID NO: 41993 - protein, 107 aa, A.fumigatus
FSMAFSNSFLPRYDADENTNHASSAPKIPDSTVSPAPAQETTSPATQTAENSKSEPEDGHTADSSAYSYDGHQGNGSGMYDTNHTTNVTAAPTTEQEPQGTGIKEDG

SEQ ID NO: 41994 - protein, 241 aa, A.fumigatus
LPQLTNSLLGLGLNASNLGSSLGLCRCLVFLHEGESKNLLDAVVVREEHDQTVNTHTPTTGRRQTILQTCAEVLVDELGLVITLVLLSGLLLETETLVEGVVQLGVCVDNLLFANKSLETLAETGVLTVVLGKGRHHLGVAGDEGRVDAGLLDELADQLVEHTGVGQRRRAFNTSLLKHALEELASFGGVQLVSRRELLACGLLQCGNHLHPPPGCLPVDVVDLTRLSVEGGLIATGNVLN

SEQ ID NO: 41995 - protein, 210 aa, A.fumigatus
APVELAMANSRLWVRSKPFVTELTTKLTYTFQTADNQHLQVQLGGNTHEQVHVKIVMVGNEGFSGSTAGDGVHHGGLDFDEVPAIKEVAHVSNDLGASDEDITRSLVHDQIQVTLAEALLLVLETVVLRRNGVQAGRQENNLSGEDRKFTVGAVLGAGTARETDNTNDISSAQVLVLSLEGDIPAGVLGLAHNLHLDTFGTDIVEEELGA

SEQ ID NO: 41996 - protein, 65 aa, A.fumigatus
FILNDCNQFFTAFGEKFRMYTLTDRVDEPGTRYFIVATSRLRTISKSLELNLTSKIELTAIILSS

SEQ ID NO: 41997 - protein, 80 aa, A.fumigatus
YLAAKDLESQMDESGQMAVYGVFSVDVEAPRDPWFTKADPCYSRLVLVNLKLVPKEPNEVPVVGLEQSAWSSGGITAVQA

SEQ ID NO: 41998 - protein, 502 aa, A.fumigatus
CSQGGLPLLTFPPHSESVADSRVIELDQPLFEVAGHPIINHCLKALAKISDIREVILVGYYDESVFRDFIKDSSKEFPQFRIQYLREYTALGTAGGLYHFRDAILKGKPERIFVLNADVCCSFPLGEMLKLFEEKDAEAVILGTRVSNDAATNFGCIVSDSHTKRVLHYVEKPESHISNLINCGVYLFATECIFPAIRSAIKRRTTRPRLLSYPSSENLEASFVAADEETEKSEVLRLEQDILSDLADSNRFFVHETKDFWRQIKTAGSAVPANALYLQKAFQAQSDELTPPSATIVPPVYIHPTATVDPTAKLGPNVSIGARVVVGAGARIKDSIVLEDAEIKHDACVMHSIIGWSSRVGAWARVEGTPIPMTSHSTSIIKHGIKVQSITILGKECAVGDEVRVQNCVCLPYKELKRVCYLALLHFLTTLTLVNRMLPTRLLCSETFKKDCSKLDLFDGLYIFLVTTNPFDSSINTLYSKPFSWTLDNVDHLGARTAIILV

SEQ ID NO: 41999 - protein, 240 aa, A.fumigatus
LLVSAFLSILNYVFTSLTHCFYGLSPRLSLLSNTILLILWLISLGLLSWSMSHTILTTCNATYWATSTGIAVCRTYKALFTFTCTSTFAAIAAVALDIIIHKRQTRLGQYDPMTSNPDIKLHERNNSAVTNTNASVPLDDERHPLQAQHQFHDSPYTDRHGISDIPGSGYADHPAYRVPPPVYGLSASAEHYHAGEAHEFSETAPARSQQGGPRVRFSGVGRPEYGYPAEQKAYDSGTYR

SEQ ID NO: 42000 - protein, 731 aa, A.fumigatus
PVAATRNNTPVVMSGLPSSETEAINLIARDMKCLVKKIQDLRHIGVEDSRIALPKICVIGDQSTGKSSLIEGMSQIKVPRSAGTCTRCPMEINLSEGEPGQDWNCRIFLSRKYIFDGSRKVTKLPKKSQPLGPWIEQDQEDEHFTDVRDKDGVQAAIKWAQLAILNPGRPSTDYQPGHNGDTDESYCQVKFSPNVVRLDISAPNFPNLSFYDLPGVISQAEHDHERYLVSLVENLVREYISQENCIVLLALPMTDDATNSSAAKIMRDVPGAKERTLGVLTKPDRIQTGESYDQWVEILEGDKFALGHGYYIVRNNPNPPIEHSRAREEEAVFFAKIPWATDLSAYQNRFGTRNLQWGLSSLLLEQIQGCLPRIVEQINEKAARMEAELQTLPDPPSANVPYILCGKLNHLKDQIRAHIDGGSAQYPLQKIWGNIARDFKRALLKTRLTVQLLAHSDKMAIPIAREDADSDCEMTSIQRSVSVNLKRKTPCDRLTPIPADPKPEQPSTPRPSGYYTEHFNRFERPARMFTWEEIREINEDSYRAGIPDQTDPKAVEVMNQLSVEHWDKPMEVFLGATHQLVRDMMMRQLKDVFRPYYQTSLYRELKRIIDNYLQTLRKEHFRHAQENYNIEHNKPFTMAISALEQATENAYKYLKARRHEARSHCFLDLQGKIPRGDPRRDAEIKKLTAAELGPDGFVQELKMMAVSSILLVRLSSSDLLIVLRRLVATMK

SEQ ID NO: 42001 - protein, 77 aa, A.fumigatus
QNPAVERCMELMAEDPERQRRRQYLLKEKEKVLKAQEWLATAKKEDDAMDSADSDSTIKSQPPEDWSSFPGFGPVAG

SEQ ID NO: 42002 - protein, 172 aa, A.fumigatus
NIFLGYSNTSRSVASESTSCARPSSPTPTLTSSRSPMTCVNTSRPTMVSPRASRSPMSPSVSPVESTPSGLQAPSSSSTISVPKVSRCRLCARPRTPAGMSPSRLSTSTCAEEISLVLSVSLAVPAPRTAPTVNFLSSPLRLFSWRPACTPFLRSTTVSRTRSSASANVTWI

SEQ ID NO: 42003 - protein, 294 aa, A.fumigatus
LSAVWNVYVSLVVSSVTKGFDLTHNREFAIASSTGAYADVYDVMNLTEELISGLVKHVTGGYETTFHTQSGEVYNVNWKAPWRRVEMIPALEEATGEKFPPGDQLHTAETGEFLKRVLKKTGVECSPPLTNARMLDKLVGEFIEETCVNPTFITGHPQMMSPLAKYHRQHAGLCERFEAFVCKKEIVNAYTELNDPFDQRLRFEEQARQKDQGDDEAQLIDENFCTSLEYGLPPTGGWGMGIDRLVMFLTDNYSIKEVLAFPFMKEDKTAAETKTAAEVAGIEPKPEEGIRKLR

SEQ ID NO: 42004 - protein, 108 aa, A.fumigatus
FNMADSNAVNEVEASVANLLLDEVTGERVSKTELKKRQKMREREAKKKEKEANAPPKPEKKVSAEEEEANLTPNVCSICTRRNLSGYSRLSGFVAKIFFLDIAILRDP

SEQ ID NO: 42005 - protein, 248 aa, A.fumigatus
QYFEIRSKRINKLRETKQPDPYPHKFQVTDDLREYLKTYDGLAKGEQKPDVTVRIAGRIYTKRSSGSKLFFYDIRAEGVKVQVVCQAQNASGDVSFEAQHEHLRRGDIVGVVGFPGRTSPKNRADGELSIFATEVVLLAPCLHAIPSEHYGFQDKEQRFRQRYLDLIMNERSRNVFVTRSKIVRYVRNFFDSRDFIEVETPMMNAIAGGATAKPFITHHNDLDMNLFMRVPPELYLKMLIVGGLERVC

SEQ ID NO: 42006 - protein, 889 aa, A.fumigatus
AHGWFLFHKRYWLLSWIRMASDSRCLCSASGCNDLRLRSGSLLIAAGEPPRSTINREPRSSRRVICCIRSSFTMSDDAKSKVFPDISAKLSALPKKSLFERQRAEAEAKRAREQAETAAVYEDFVKSFEDDSGPSDRITTGGRPNNTFGGRSAALGGGPAKRHFTSSGPRSSGPGTLGPPPSSLSRKRTHEGFQPFQRNRESAQGILGFDNTGSASSPAALAFRTSDDEEDRVADAKEAERAAAKPTLYLASLPPGTSPSAIKSLIPSVLSVDNVKILHPSNQSPTDRKSISAIVTLANESAASDIDSTVSALQNKYLGWGYYLSIARHLSSAAISSSMPVTVGPSSTSSLPFGAKTITPEYGGRLNRAPPPGSHRGGFAPPASYGAAYGRSGPVTQVEVKTPSDLKQLRLIHKTLENLLNYGPEFEALLMSRPEVQRDEKWAWLWDPRSAGGVYYRWKLWDILTNSSPKGARRGRSRNASILFEGGPSWVSPDTGIKFEYTTRMDEFVSDEDYNSSDEEMSDGEDERRHLGGAPPADGAGTGNEGVGYMNPLQKAKLTHLLARLPTTHAKLRKGDVARVTAFAIGHAGAGAEEVVEMIVSNIMNPFAYTGANPDREIEKGLARQEASKNESSHASVEGASSLSKTNMDTSSAKLVGLYLVSDILSSSATSGVRHAWRYRQLFESALKSHRVFEHLGRLEKDLNWGRLRAEKWKRSVGSLLHLWEGWCVFPQSSQEHFSQVFEKPPLTEEELREEKAKAEADRAAGAAFKGKNRWKTLEEDETAGKFDPSRPPAQPVHNRMDIDQGHTASAGGDLAGEPMSDIDGEPMEDSDLEEALDGEPLEEDSAMETEQKEEAPSKSEAPSQLESGPPARKPRPRAEDMFADSDTE

SEQ ID NO: 42007 - protein, 113 aa, A.fumigatus
EVDGSFSYSWDSVIVQSVNIAAVSSLPEGAAPDRDLRCSAFEHGGRHHGHGHRWSAGTLGLSYLIRCCVVLVLMSEQVDEEQKPMSYSQTFQLLREGESYYVFNDMFRLIYPA

SEQ ID NO: 42008 - protein, 268 aa, A.fumigatus
HIHSWSDSHLKAFLDRHGVPVPQPRRRDVLLKAARENYEAIAKKVGETAHYPGNWLYEHWTESDLKEWLDERGWPVPQPTTRDKLIASVRRNARLASLQARSIAASATKSAEAAQSSLSEALFNAWSDSDLKKFLDEHNVKVPQGSKRNELIALARKHRASLVSQASVASKTASESAASVIGAPTSKAGNQYTRATDQANLKAQDAFDAAVETWSDSRLKAYLDARGVPVPQSSKRDELLAKVRLNKHKAATGWNAWTFDTWNTDQLK

SEQ ID NO: 42009 - protein, 174 aa, A.fumigatus
ESPRVCVKSHLSNFADRKYLSSMNAKAAHRTDVTRDELIKQAQEAYAKASKAGGANIASATSYMAQATDAVKDTTFDTWSHSELKAYLDSYGIPTYQGSSINELRAAARRNAQYFRYGTTSPQGILYSKLQEWSRWAMDQLKIGALSGRAQGQEAAEKAKAKASEGAEKIRSEL

SEQ ID NO: 42010 - protein, 85 aa, A.fumigatus
LTTNGTKLNWNDGSPIMVRFFSIDTPSIHTANDAPDIPYPTPADRKALEDLVKRNWDSKIQKPLGNAVENSADQWHHAKEWIFDT

SEQ ID NO: 42011 - protein, 144 aa, A.fumigatus
RRPFALPAKFPPPVGVRHLSTPTTLPWKTNGEGRKNRLILPFRGRVFERDPRQGNFTALKAWGSDLEYRRKIQLKPVCIFQGGPYENFAGRDASRGLQHQSFDVEMLTKDLKVLLDDLKDLNEEQLENLPVLGGALSGEVSRRG

SEQ ID NO: 42012 - protein, 62 aa, A.fumigatus
SRGAKVVNGIYHFCSNSMRDVLRLRIYFSEDLLRRTIDKMTQSRDRVKEALVSHDNVYKGIS

SEQ ID NO: 42013 - protein, 93 aa, A.fumigatus
TSTNEHSLIIFGILLSYLPQHIRIINLKSSFGISPYFVLLGTTSGTSALANVVTQQQSLHDVECCKNINGLACFGGLLGIFQVGTQWLCFVIM

SEQ ID NO: 42014 - protein, 244 aa, A.fumigatus
CGMLQEHQWTSLLWGTTRHLPSRDTVALLCYHVSSPTSPPDNIHVINARSCSLLLFVIYFPRATSPISPTESESSARNGPSYTTALVVSGICILHAVVMFITSAAIAVNRPSQLQAWSNFSGVVAAILASIQYFPQIYTTLRLRCVGSLSIPMMCIQTPGSLVWAGSLAARLGPKGWSTWGVLIVTACLQGTLLAMAIFFEYFGPNKQRNHRHGKDLPPNGSGEGPEERDHEQPSEETPLLQGQ

SEQ ID NO: 42015 - protein, 557 aa, A.fumigatus
RTIVAASTMTAPLVKDLHRMQELFSNIVAALEAMIVFPSLFRDPSRKRRKTFHGAYWRRRTLDNFAEEVDRLFTSPLSLRNMIIMSEKIREQFKSCLQSSPVCMLPSYNHALPSGTEKGTYLALDVGGSTFRVALIELGGAGAMKILQESSSPIDNDVKLLEGTLFFDWMAEKIESMLSAVGADYGREAVPLSMGLSWSFPIEQTSISSGLVIHMGKGFLCSNGTLGQELGDLIVQSCRRRSLNVRVDAIVNDSSAALLSRAYVDPKTRMSLILGTGTNVAVHFPVREIGLTKFGTRPPGWFDYAKHVIINSELSMFGGGILPMTRWDDILNQTHLRADYQPLEYMVTGRNLGDIVRLIITEAVETANLFRGELPHSMRDPYSFDTSIVAFLEADTSPSLVPSAALLQKEHTFPVSPSVEDLRFLRRICQIVSKRAAGYLATAIHSMWCLRNDAEFSDPTESKASSVKDTQEITIVESEEDSRSLSIACDGSVINKYPGFRDRCQGYLNQLTQQTNSSQGPLDPATSPYIRLELAPESAILGAAVAVAVAVEDQKSG

SEQ ID NO: 42016 - protein, 74 aa, A.fumigatus
TDIDDFTYSHILKQESMVTSKMGNNCSAKDNDPFRNQHVRIYHAICAIFRFNCNCMLCMGPDFECNILKTLKYQ

SEQ ID NO: 42017 - protein, 479 aa, A.fumigatus
AGYRLKAFPPSGSGIKMRWSSLLKAAVLYRAILSPLVSGAVIPRGAVPVASDLSLVSILSSAANDSSIESEARSIASLIASEIVSKIGKTEFSRSTKDAKSVQEAFDKIQSIFADGTPDFLKMTREILTVGLIPADILSFLNGYLNLDLNSIHNRNPSPKGQAIYPVKAPGDARYSVAENALRAAIHIPASFGYGKNGKKPVILVPGTATPAGTTYYFNFGKLGSAADADVVWLNIPQASLNDVQINSEYVAYAINYISAISESNVAVLSWSQGGLDTQWALKYWPSTRKVVDDFIAISPDFHGTVMRSLVCPWLAALACTPSLWQQGWNTEFIRTLRGGGGDSAYVPTTTIYSTFDEIVQPMSGSQASAILSDSRAVGVSNNHLQTICGGKPAGGVYTHEGVLYNPLTWALAVDALSHDGPGDPSRLDLDVVCGRVLPPQLGLNDLLGTEGLLLIALAEVLAYKPKTFGEPAIASYAH

SEQ ID NO: 42018 - protein, 96 aa, A.fumigatus
SNRHNRHRPGNPVSGTRTSDGAYYVNFPGGVNDIAVFTLEVQRVKGTETVSVTLNDNGNGSAPGSKWSCTSTSGSVMGTVKKCAYDGDITLTPFNA

SEQ ID NO: 42019 - protein, 127 aa, A.fumigatus
TSSSSASNNATQLFISNPFSSYKMKVSTIYSVVLAAGSAIAVPGKRAGQAITISDLKASQVDQQGYITFALKDPNYDDSTGANVIWYIYVPSGPIRDLTDIIGIVLETPFPALALATVPTMSISQEV

SEQ ID NO: 42020 - protein, 182 aa, A.fumigatus
YRIFKPLVRAAWRTFRSGPKLAVIPHSKTPTVFLPSITSTYAPLFECDYNMHKSNSTYFTDLDASRSYLLSALCYDGLVTVDRELAAEGKKGMLAAIIGSVTTSFKKEIRIFQEYEVWSRILTWDRKWLYIVTHFVQKGSAKPTGYLIAKSTRLDLKRSTEESRCHSGQPVTFATIDFQIRL

SEQ ID NO: 42021 - protein, 101 aa, A.fumigatus
EKGGFTSLRERILKASGLMGQDNKEEKREVLPNNVQGHTSDSGVPEDIESERLKGMKYAESWNQLDSLHEELLKQDELVNGVLALNHFGDISLPWKRFTTA

SEQ ID NO: 42022 - protein, 124 aa, A.fumigatus
EKNIPEQRGIFDLPCRSMRDILVETFLTLVTPFAPIIDILGFLRHYRIRLLHFSCYMPCSPSVQGSVHLEVRTQGPYQRSLQKGKSLVRCRLRTRSDPTHPVNAILGLYWEGRRYLSTPAVLFG

SEQ ID NO: 42023 - protein, 75 aa, A.fumigatus
STRVLRLLDCLKFDADTMSTYVVSDQPLNNSLVGSISSLLSAAGVPNLLWGNYLLTVYGVPTIVDVSVLPVRAID

SEQ ID NO: 42024 - protein, 73 aa, A.fumigatus
VIVLSFSTLFLAFQEGSEEDTFYARQFKTYNQRVIKWLQKVCSEHPVGFPYLNDDSPSIHTAPRPLSDDLGLA

SEQ ID NO: 42025 - protein, 219 aa, A.fumigatus
SSGFRRSVRSTPSAFHTSTMTAPQSTPPRVLSVTISASHNFSKNAVSSIKLIANLGVEGDCHAGETVQHRSRLHIKPPPANLRQVHLIPIEILRGICATLPTDEMRTQLLAPGALGQNITTEGVDLLSLGAGTEIRFVEDGEAVGEEAVITLTGLRNPCPQIDKFQAGLKEQFLVRDEERNIVRRLAGVMATVKKGGVVRPGMKLIIDKPSQYVPLDVV

SEQ ID NO: 42026 - protein, 61 aa, A.fumigatus
KISTSELFTDGAMWMRDILSTRSVYISVTFENNRTATIRASDTVSINLREHQLYNLQSLFL

SEQ ID NO: 42027 - protein, 179 aa, A.fumigatus
TAYAPDVSLVNGVYHVYYSVSTFGSQSSAIGLATSSTMDLNSWTDHGSTGIQSSSSKPYNAIDGNLFKDGGTYYMNFGSFWHDIYQAPMNSAATSVASSSYNIAYNPSGTHAVEGAFMYKYGNYYYLFFSAGICCGYDTSRPASGEEYKIKVCRSTSATGNFVSESQEETLKVVKLMFS

SEQ ID NO: 42028 - protein, 144 aa, A.fumigatus
RNTTLTLYRWFSTTMGTGIVAILFHLIPFGHTYLHYVSIVFFIFNVVLFAVVLSMSILRYTLYPEIWAVMIQDPTNSLFLATCPMGFATLIEMWVFVCVPAWGDWARTVAWVLWIVDAVAAASVTVSLSFILYFQPLVICLAKG

SEQ ID NO: 42029 - protein, 140 aa, A.fumigatus
MNGTHIYRKFVPSYHASFLTIVKLTGDWSVAMSASVFVVVASCLAALAHGYANPGSCLGACNVHDPALIRRESDGKYFRFSTGNKISYASSSSIEGPWTVLGSVLPSGSSIDLPGNDDLWVSNFSLDSICFLLTQSEFSI

SEQ ID NO: 42030 - protein, 97 aa, A.fumigatus
CSLRLMLTVSLARMVAVRLFSKVTEMYTDLVDSMSLIHIAPSVKSSEVLIFHRGVFTDPSLGPILYYHYVDTTIGYADSQKLFGWNKIDFSSGWPVV

SEQ ID NO: 42031 - protein, 374 aa, A.fumigatus
YHHQNLKMQLKEVLSLYLLGVSLVFAHPGHEEKRASNELLAFKAHVRRGLSLCTRSFDESGLSARAIARRAKLASEYRRRKLAVRDTDDVLNTSHLSSADYTTSTDEREIFSSTGTCVLNPEGETGPFWVSGELIRSDIIENQAGVPVVLDIQFVDVSTCQAVEGLYIDTWSCNATGVYSGVSGNGNGNSADTSILDETFLRGIAKTDSDGVVSFNTLFPGHYSGRTTHHHIIAHLNATLLPNNTLTGGTVPHIGQLFWDQSLIDEVEATSPYSTNTVAQTTNAEDRVFSDETSGTTSDPVFNYVRLGDSVEDGLLGWVTVAVDLTATYTPNYSFVYTSSGSEAVSGNSGSSGSAPGSSGSAPSGGMGGGPGGF

SEQ ID NO: 42032 - protein, 269 aa, A.fumigatus
PSTERRQLVVDEESAVLGLPGNRETRLKLDADHSQMCKVGSRGPMYKLIKGNIKQIVDQVLVAEQGYIPQQSTSSHAGPPLPTVTHTNSSSPYPSAPPPTTGQRIVGTMYTAVDSDPRSIKAAEHKNVGRWDQARNLEYAIFQEHLRTLGPDHNSTIVVGYNLAEIDLEASYLAKATEWCKWVTDQSQRTLGPRHPLTLRAESLMGEILCARGRYQEAESVCANVLARQQMSIGDDDLDTLETRRRLSAAYANLAQEQTSSPGGWKDRR

SEQ ID NO: 42033 - protein, 112 aa, A.fumigatus
SDDSRILYLGKVLRKVVESHEAIDPIAGSIAYTMGLFISLLMWSFGLIWLVFALATIYHASPFPFNMGWWGFTFPLGVYAANTLLLGQQLDLMFFRIFGMVSIYQHLENYEY

SEQ ID NO: 42034 - protein, 140 aa, A.fumigatus
PCPKFPRALSILFYGLFYDLSTQLYIGRKIPIHRTGLFLNSTCAITSRKLTMAEGSQETEDQSVQVPRASTAPALPAIITTTTTVRSRKDGQRNDDNSFTNDSPSVATPGLLRTSQSFPVGMCNSYRLPFKDWSFRQICQ

SEQ ID NO: 42035 - protein, 204 aa, A.fumigatus
RGIFVIHRKGVSFLSRIIGGKKKENLSEAEDDVSEPDTFRMDANAAAQPIGFFPKFPPPPKYIRVKAYYKKDKTFSRVFLAQELTDIAAPSNNSVKDATGSTTGTLSGGNTGKAIWALSFSKDGKYLAAAGQDRRVRVWAVIASPDDRKEEGLGEGEETQGADEPPQLKAPVFRTKPIQMYEGHSGSVLDLSWSKVRCSHRRGI

SEQ ID NO: 42036 - protein, 157 aa, A.fumigatus
TKPQVIVTDPPMQTTQTRITTKYGFPSQRPSAQKKPSSTSNPETTDSPARTATTPVAVLTLKTYNPTAGICLKYRTNKAAEVGRLVTSLGKLAGGANAAGLGLSAPAPTTTASAVATDVEMTDAPAVVEEAASANASKADTGAKGGKSKKKGGKGKR

SEQ ID NO: 42037 - protein, 129 aa, A.fumigatus
TRETRQQHTCINCVKEVGPLLRLLDVCINQQGVCLRMNVLNHDLEAVEASSLRHLHLIAEALQQVLINDSVRGSEEGKDMRDEITLIVIQTVVPVVQIFGEINLLGGPEGSFGFLVHLPNLRRRSGAYQ

SEQ ID NO: 42038 - protein, 569 aa, A.fumigatus
SDAGDQNNFLLSSSMDKTVRLWHVSRSECLCCFQHSDFVTSIQFHPRDDRFFLAGSLDTKLRLWSIPDKSVAFVAAVPDMITAIAFTPDGRHSIAGCLNGMCNIYDTDGLKPVGQIHVRSARGRNAKGSKITGIDTITLPRGDPNGEVKLLITSNDSRIRQYNFKDRTLEAKYRGNENTCSQIRASFSDDGKHIICGSEDRRVYVWPTGAVEKDFDKRAVEVFETQSAIVTAAVMAPSKTKQVLGFSDDPVYDICNPPPVTLVSAADNENARQNRNSDIIKLAQESPSYLSRSTHPEGNIIIVADYSGKIRVLRQDCAFQKRRYENWDTHSTFSRRLLRRSNSARHSISSSIGKESSHKTPSERIISWRNSVIGHDTAKREGSRDGTRTRSPSPHTSIPDVSRYSGPVRQFSGGAPADSLSLTVSPPPSAYKSSFDSRRSSVEASKRNAEDVRMVPTARTIVAKGKDKDNPLWLQGQQSYAFWNKITHDALAAQNKTPSQSRDSNRLSVPGRKFSMASALSSDYGSSNGEGDEGDVLRCDNCQGTNFRATKSRTGKQKLICVRCHRPIS

SEQ ID NO: 42039 - protein, 92 aa, A.fumigatus
AASSLENLKMSDSPVKKLNFGVVGKENAPSSTALTDAPTEKIAEKPTEASKVAQSIKELEANEPLLQENPHRFVLFPIKYHEVSGTSTTRHA

SEQ ID NO: 42040 - protein, 205 aa, A.fumigatus
FPLVPCIRKKAQWAMRWISDKESTFAQRLVAFAAVEGIFFSGSFASIFWLKKRGLMPGLTFSNELISRDEGLHTDFACLLFSHLNHRPDKKVIEDIIVEAVAIEQEFLTDALPVALLGMNSKLMCQYIEFVADRLLVALGNKKYFNSPNPFDFMESISLAGKTNFFEKRVGDYQKAGVMASTKKDASQDTAKDANDGGLCFDEDF

SEQ ID NO: 42041 - protein, 197 aa, A.fumigatus
TIASREPSSLRSFPNQVSRGEWHVHNASRVKWFTPHHVLYVRCLLICPASSTQIWQMYKKAEASFWTAEEIDLSKDLHDWNNRLNDDERYFISHVLAFFAASDGIVNENLLERFSNEVQVPEARCFYGFQIMIENIHSETYSLLIDTYIKEPKQRTYLFDAIDTSMLLSRFSRLDRSLISSSSLYQEEGPVGHEMDF

SEQ ID NO: 42042 - protein, 121 aa, A.fumigatus
LTLETRDLSTRLGLNQDEGEKWIVNLIRDTRVDAKIDYKEGTVIMNHPPQSVYQQVIEKTKGAFFRTQVLRFVRLLYPHDRQVTNFNFLTVRLLRNKDMVQIYAPKTQFIFFSSSEWFCSC

SEQ ID NO: 42043 - protein, 65 aa, A.fumigatus
SSKHSFTVLSRLLNLTGEIKNKKNQEQFGIKFSCYPTSAFSLWFRWDFVIHIGREILPESPQHHR

SEQ ID NO: 42044 - protein, 63 aa, A.fumigatus
AQSESTHVRDNGQINTKIICMISKELIEVRDAQLQYNPTRLEKLISIPIYNQYRIFQTRSHLQ

SEQ ID NO: 42045 - protein, 198 aa, A.fumigatus
NYLMDVGNLHPQSTDQLVRASDRLALYQKQLQASVLSPQITSSSHSISNAAKATDQMSRDPITCHVLNTLSGTPAANLPVTLTFLGSSNGNNASQSPITFNATTDADGRVKNWTATAATATTVSGVLSSLPTADSKTNWAVRFEVGPWYAAQGIESFWPEVEVKFTVKGRGREGEEDWRHYHVPVLLGPWNYSTYRGS

SEQ ID NO: 42046 - protein, 71 aa, A.fumigatus
GTIVTGHVEHYPIRINSCDGTAGFVDFNYLVWSENQANHNMNHARGAGRPDSMHRLRESILHHCKGWLSLA

SEQ ID NO: 42047 - protein, 367 aa, A.fumigatus
KTTPLEEIANQYNLLPKLIPYLDRHLVFPLLEFSSGQDDEKEIVRAKYELLKHTNMTDYVANLWKEINNSDDIPDEFVKKREEVLAKLQQYEEESAKITQLLQDESVVANLRSDKVANLKFLEEQHGVTVEMVNSLYDYGRFQYSCGSYGNAAELLYQFRVLSTDNDKVASATWGKFASEILTTSWEAAMEEVQKVKDSIETRLFNNPLGQLQNRSWLIHWSLFPFFNHDPARDVLTDLFFSPAYINTIQTNCPWILRYLAAAVITNRNRAHKNSSVYQKQLKDLIRVVRQEGYEYNDPITDFIKALYVDFDFEEAQNKLGDADEVLRSDFFLVSTTDAFVEAARHLISESYCQIHQRIDIKYVTAS

SEQ ID NO: 42048 - protein, 70 aa, A.fumigatus
RTSTTWYCSISRSSHLPLDRNTSASANGVVFIEKLVRVPVGETEPEWQLATSADLILSSNQKIKNLRSRD

SEQ ID NO: 42049 - protein, 242 aa, A.fumigatus
FFYFCICLSVNTFKSGPCDSYLFRANFLGNFQYTRIKSFWPLRGSKYVCKFNPIAAHRTSRLPLGKEFEHFLTALSCNRFLLTRFSTSESLKMSSTAVVHGDDLMEPTLQSILSQKTLRWIFVGGKGGVGKTTTSCSLAIQLAKVRKSVLLISTDPAHNLSDAFGQKFGKEARLVDGYSNLSAMEIDPNGSIQDLLASGDSQGDDPLAGLGMGNMMQDLAFTVCAVLNSTGSVCVHTDNQCP

SEQ ID NO: 42050 - protein, 209 aa, A.fumigatus
IPGVDEAMSFAEVLKQVKSLSYEVIVFDTAPTGHTLRFLQFPTVLEKALAKLSQLSSQFGPMLNSILGARGGLPGGQNIDELLQKMESLRETISEVNTQFKNPDMTTFVCVCIAEFLSLYETERMIQELTSYGIDTHAIVVNQLLFPKEGSGCEQCNARRKMQKKYLEQIEELYEDFNVVRMPLLVEEVRGKEKLEKSVPIHHLFEKNH

SEQ ID NO: 42051 - protein, 82 aa, A.fumigatus
TAILREHPIKLIYLQESQLRTTNTLAKMSQVQQYWLPGYGLSRHIVLGHIQYFLGPSATVRPYTYQVNDYLVGERVKWEESA

SEQ ID NO: 42052 - protein, 65 aa, A.fumigatus
DSKAGHIMITGLDYDSFFGCSGFDVHRLGSFVLDTFSNGLSIPTNDTRDISLHKQSHSSLSPAPI

SEQ ID NO: 42053 - protein, 158 aa, A.fumigatus
DYLLIVANPIPFLLVEYRKHYLTRIFGSPYYGCYFLGFIIFTLGLARDHVYQLALQDQPYYAPVHQPILGSVLFGIGSILVLSSMYALGVTGTYLGDYFGILMDAPVTGFPFNVTGSPMYWGSTLNFLGVALYFGRVAGLLLTAEVFVVYWIALQWEE

SEQ ID NO: 42054 - protein, 63 aa, A.fumigatus
FLAGLVVLHVQNANQKSSLRSYKQVTSPTKDSANSMLCIYSKSADLRVIEVVQYGLLTMPRAR

SEQ ID NO: 42055 - protein, 194 aa, A.fumigatus
ARRPRPRLPVALLSSTVSISSSSTPFLSSSPSARPHFSGSYQSSPSLNSPTCPSALHHSKTSSCIRHARSRHSSMCSNPRTVSSCFWIKDQSSRRVSSASLAGSPKLGSGSTDSGTRNSGCGAGSALSVSVEAEGESLLESWSGPGFKALACARVVMRRGGSGDEPSCISVSVSSPCGSSCCSASTSAPCLSFA

SEQ ID NO: 42056 - protein, 133 aa, A.fumigatus
VSAVSLYSRAYRHKRLNCHCPSRHKRLDGKPETPPCGNGVRVKSSSCVRYRKLNTSPNTIEDKDILKMYLVTPPVKKIDLVWPLGLSVTARNLKGVTVKDALDAIYKQFKKKARLSARFFRRPSCHFTTDRSL

SEQ ID NO: 42057 - protein, 1012 aa, A.fumigatus
VNTPHVRLTSNSSYFSPPTFICLSSISISVCTLSQPAQVRYLPVVLMFVCRCCFTSTNNSLIVLSIWFLPYFRSCYPSSYSSVLPSFTERHGTTLAYQSIPPGTMALNRRDIILFSTGGFIAWGLAVRWLPILRYLGYALVLGALLSCTAVLALVFLTIRPLDSAKPPRSSSLPLTFLLPKHWPREVEGIRARSTYRTDSLYPQSFIVSESIDELLSLVTRDFIASWYQHISPNPAFVNEVDRVIRAAIGNLCNRLLAEDLVSLVVSRIFPILTAHLKEFDVAERSVRGRNLTRNVTESEELDLAIAKKYRDGRLHPAAALSVSDQKFVEQEYLRKITLGLLPKLFPEQVLNSRIVTVLIREILACAVLFPLVSVLSDPDTWNQLVEAYGRTTIQDRKTVQKIRAALDEHASPAPKSKHGHPFPKLAPNDSERAFERFVRAIRRCNNLSDARRFRALVASQLKRESMVEGQDPVYLRRLETGKRVLDQKVAKLSAPGGSNTPYANAVESHFRRNSSSSKPEASLIDVMHDASGLSYFMEFMDRQKLMSLVQFWIVVDGFRNPLEDDFGDETSPSSSTWTTADRNDMALISETYLAKPELKVSEEARRAVKAFLSAGKRATPEQYRKARTVILSTQSAVLEELQTVYYPKFKQSDLYYKYLASDEVSLAGSRASPVPVEPPARRPLPPLMARTASHPGQKPKDLRRAVASSSDARSMGKLFDDEEQARRSIDSERSTPLFDDDYDTDPLAASTHSLGNDSQSGFNDATQNQAIKSMEAALNDIIANDPENADLGEVRYIDSGLAGSFSVDRGLKSPRSTGDLGRLDNRMDDNKAKPSIASLGLVDQSSRIGVFDDELFPDQQKFLEDEYDEPPETDDKDPADEVQEAAPGDLGLTEAIEALTVDIEKLAAQETVIDALTRKADLTNNTAELRILRKSKASIQREIHRKEMQRQQYIIQESDNSLYGRSTVRIQSIVVGKEADGREYAMCKSILPVSNIVVFAVVTDSNCFRRD

SEQ ID NO: 42058 - protein, 339 aa, A.fumigatus
LTRTVSDVIEVQRDAGEQMPAASWAVARRYSEFHELHQRLRIRYPSVRHLEFPRRRMVMKLQKEFLQKRRLALEAYLRNLLLLPEVCQTRDLRAFLSQRAIIPRDETPRDGETKDLVTRIYNSVADGMDDFLGNFGVLDQLSAAGQNLISAATNHQHSPVSNSGLATEDAVTAAEAEAELNAFEDRELEPFIKPICDLFLEAFELNKGNNWLRGRAVVVVLHQLLGGTIERKVREGVRSLVQDESLLRYLSMVKETMWPGGVLRQNKVRTASERLKSRTEASLVLATLIPDVAGNVVGRANAQGAARRIFATLNNQRLNSHLIFSILDEVVLVLFGGAK

SEQ ID NO: 42059 - protein, 83 aa, A.fumigatus
  UNSURE (66): Identity of amino acid sequences at the above locations are unknown.
RDRCYSGRLEKDSQTAPSPPRVTMTDSQSTFTSVLHTQVITPSDSFDVFSNTVYDLDSCNQGQEKXRRKEKKRREKKNPLDPT

SEQ ID NO: 42060 - protein, 504 aa, A.fumigatus
SFVPDLASLIKDFGIQPEIAFWIRRPSVSRKVADAEKAMQEEEAAAAAARAREIEAAPIKSEDDKMETTDEGEMNGPADESAENSMDVDKEQGMTNTEGDSNPTSGQPEQPASSSPTLNPVMQDLEDQVKSALTPETWGVVGLHFYVIFWQLSLYDVHIPQKAYEDEIERQKKKVMAINSDRSDISMAGTQRKEREKKQITQLQERILEENKAHLKAYGQTRARLQKEKDRWFAGMRGKHDSLNVSLLEQCFLPRLLLSPIDAFYCFKMLKFLHTSGTPNFRTVGLLDQLFREQRLTALIFQCTSREADNLGRFLNEVIRDLGRWHADKAVYEKEAFGTKKDLPGFAINVDPEGKPTTFLEYEDFRRLLYKWHRLLASALKICLNGGEYMHIRNAISVLKAVVQHFPAVNWIGRDMLTSVNNLSQNDERDDVKIPAASLIGDLNRREKKWMLPQAFMISNQPASKGPAPAAGKPGTPGTPRPRSTTPASLNAAAPEFKPPPSAE

SEQ ID NO: 42061 - protein, 589 aa, A.fumigatus
PSERGSFQPRGWQNRRPDEDELPEPSDQKVMLLKSLLAIGALPEALFILSKFPWLMDAYPELPEYIHRILHHSLSKVYNSLRPLPTVEELREQQQIPSQDQGGLAKGQIRLTSAPPRRVLRWAQLDKDDTNDGTDYRFYWDDWADNIPVCQSVDDVFALCSSFLNISGHKIGLDPSLLAKLARIGKFSLTQDDSTENKARWQDLCKRLLVPAISLTKANPGVVNEVFDLLRFFPRATRYNIYAEWYSGQTSRLPDIKSAFDQARAETKDVLKRLSKTNIRPMARALAKIAFANPGIVINVAISQIESYENLIEVVVECARYFTYLGYDILTWALINSLGQKGRSRVQEGGLLTSRWLNALATFAGRTYKRYSIMDPTPVLQYVVEQLRQNNSTDLIVLEQMISSMAGIITDTNFNDAQIQAMAGGEILQSQTILQLLDKRHESKTTSKRLMKALTVSELAGQLLVAIAQERWTCIYKATEGDSELKLLGNVFDEIHRILAQYLDVLRSNMSVDEFDPLFPTWLLLSRTSVFSRRLRFGSADLAFPVRLPMLKRQCKRRKQQPPLRGLAKSKQRPSNPRMTKWKRQMRVK

SEQ ID NO: 42062 - protein, 292 aa, A.fumigatus
HRKILTTFRFGTYSTCDAINAGLDLEMPGPTRWRGTALAHAVSSNKAFEFVMDERVRNILNLHNFVEPLGIPENAPEKALNRPEDQALLRRAAAESVVLMKNQDNILPLKKEKPILVIGPNAKTAAYCGGGSASLDAYYTVTPFEGVAAQSQGEVTFSHGVYSYKELPLLGPLLKNDDGKKGFKFRVYNEPPSEPNRQLIDELHLESSSGFLMDYQPPKIKTFTFYVDMEGYFPPEDDCIYHFGVTFVGHGKLFVHDELVVQHSKNPPECHRHVPATPPSKNKCSKELQGRP

SEQ ID NO: 42063 - protein, 839 aa, A.fumigatus
QIKTMRRPEGGPRQEVTKKSEVEDGEIEDAKMTDVSAKDIETSNQVAQKPAEKAEAASRQGEESIVTQPPETTSTQPTSEKPVASTEAYTGVELPSHPRISDSPAASKTATKASESGRLPNVPRRPESDRAPFSSPNMRPQSQMPSRPFRGDDGRLPPRSDIMDARRDRQSDFPRGGRFGDHEHSRSFEQPGPEGRSYGRLERDFPSRPPADEPFRGPPYRDGRLTREADGPDRAGRLRGPPDSREAPSSRSVPPGPQTHPDRADLIQEHPERGGDGYRRGEQMRQEKDDRRALPTRALSPPRADLPNRPPPDDRRFPSHAQGRSRYDDTPTGPRNDRPSRAPMDASEPREPGADMSHGRLRQPEPASDIPSGPRGRNPSGRGGRTASGLSHATPSSPAGAADRQPPTGPGRQGMRGAPEQSSSTGPSSPTIEKLDASGIHPDRLKALQQQASEDTFGGSPRSHQSLSPASTGPPSGPRSGLAPLSGPNSNNRGPPSGPAFGGERGRGDKRFAGINNMLQQSGGPGDRGGPGTQIRGRGANRQSTMGGPSPQNTRPGSPGASEEGSRSGLSSHGRPDLLIGRPSASFTEDDGPSKGRLGGGRREPAEETGSESRRSGRASHDRERERDRDRDRDRDRERDRDRDRERERRGGADEEGGRSSSHREERERVREFERERSRRGDTGGSASREERYDSREASRRGTGSREENRRRDRREREENPEFGPSSHEHEGRLRPPSSLGGGPPPPPPPPLPGNAEEDRRWGAGSGGGNGGRELRDRDRDRNRDRGRDRDYTRDGGSGGPHRKRGRPGGDDGPGEGGGGGGRGGMRMGGESKRPRRGQ

SEQ ID NO: 42064 - protein, 240 aa, A.fumigatus
LSQLVSDGAISHVISNHEWMKFWCYTSTMELTRIMITGIDFWHTAAVPRLNIPSLRMSDGPNGVRGTRFFNGVPAACFPCATALGATWDTKLLYEVGRLMGEESIAKGAHVVLGPTINTQRSPLGGRGFESFAEDGVLSGILAGHYCKGLQETGVAATLKHFVCNDQEHERLAVDSIVTMRAMREIYLLPFQLAMRICKTACVMTAYNKVNGTHVSENKQIITDILRKEWGWDGLVMSDW

SEQ ID NO: 42065 - protein, 71 aa, A.fumigatus
LVKQPRLRQLRVTFLPERDKFLFGNAVSKMFILLPMLMDTQRGDGLLAPFGRIVMARPDLDVIGQAQDLPP

SEQ ID NO: 42066 - protein, 481 aa, A.fumigatus
SSCRSTLASFCSLALQFSYIFRSHIMSVMFRSRVTVAASAAVSHSVFAAQNASTVTRGFATAAVGTSRNHRVVVVGGGSAGLTVSHQLLRTGKFSQDDIAVVDPAIWHHYQPGWTLVGGGLKNKEDLRQPLNGLLDPKLRFYNDSVHTFSPENNFITLANGDKVNYEHLVVVPGINVDFISIKGLPEALADSNSLVSSIYGYDTCDKAYSSIEKLQKGTAIYTQPAGVIKCAGAPQKVMWLALDYWKRAGLYNPSNPSSGAIQISFATALPGMFGVPKYSAKLEELRKERKVEGLFQHDLVSIDGDKATFKRLDGQEQVTRRFDFLHVVPKMGAHAFVKNSPLANEAGFVDVDDNTTRHKKYGNVWSAGDASSLPTSKTAAAITAQAPVLVSNLLRTMEGKELDSSYDGYTSCPLLTEYGKVLLAEFKYAGEPKETFGKMLGIDQATPRRAFYHLKKDFFPWVYYNYMVKGTWGGPKGWIR

SEQ ID NO: 42067 - protein, 140 aa, A.fumigatus
LNRLDNVFCGDLIFHSDIGTARCDFPGGSANNLYRSGRKVLGLPDHVKVWTGHDYPPEGRKEPVPSLSVHEHRQQNKHLRDGVTEEEFVTLRKERDSKLAEPRLLHQSLQMNIRAGRLPKPTESGQRLLHLPLKLKGLKW

SEQ ID NO: 42068 - protein, 374 aa, A.fumigatus
HHHPDVISSIQIKVKRRLHISRRPPRPETKMDRIYRNVAFQLRPNLPLHIPTCSHSTRSISILTIHRPRITNFKSGVTKTQIGREYSLTTSEENMRIAITGARGSVGQFVVKLCADAGHSTVQINRTDTDYDGTPRSEMATADVANDYDACLKAFKNCDAVIHLASIPDPVDKPDHTVHNNNVNSAFNCFRAAAELGIKRFCYASSVNAVGLAYANQPLQFDYFPVDEDAPQRPTDAYALAKHEAEIQARSFATWFPGMKIACLRIHEVAPLKDVQKEHQEDWENAAVKQLWGWVSPQATARACLLAVERSDNFEGCQVFNIVAPTTTQDTPSEELAKKYYPGAEIRGDMSKNQSFFAVEKAQRILGWTHDEKE

SEQ ID NO: 42069 - protein, 230 aa, A.fumigatus
IVVFILSTGPTNKPTYQSQIPTILPNYYLSTTMFKSAALFSLLLAAATASPTPSEDLEARACAGLGPSVIDVLRVSTPDNASPGQQFTLSRAGYPPYNTQISAITFNYIPPNATGCMLEIDIPALSQPNQIAEGATQVDIWTTDPWNYLSLPTYNSPPKRREMVGTYIFPTQPTTEASKTIIASNTCSDTMSFLVELSNWQQQSGSVTFYNTLGGKQGIEPTGFKMIYNC

SEQ ID NO: 42070 - protein, 163 aa, A.fumigatus
GSQLLALVAPSANLWSNSALMPATPRCRSIAPTPTMTARPARRWQRRTLQTTMTRASKHSRTAMRSSIWHRSPTRSINQITPSTTTTSTRHSTASAPRRNWASSGSAMLRQSTLWGWRMQTSHSNSTTSPSMKTPRSDQRMPMHWPSMRPRSRHARSRHGSLA

SEQ ID NO: 42071 - protein, 63 aa, A.fumigatus
EILISPVGPPAPVSATMFKFVMLGIYYVSCINSDVMHRSQSPIQSHVFGSPSGYRSIPDALAA

SEQ ID NO: 42072 - protein, 265 aa, A.fumigatus
AQTYLNMASIQPHICRNWQVTAGLFGAPPTAVRVPLRPLPYRATQKSPYTTGKVHLRPLAVYTRPLSKVRALNNRAYPSKSSLNGPVHRVPYSTATMEPGEPTIHDVFESKTGTWQYVVADPTTSTAVIIDPVLDYDPATQGITTESADALLSLVKEKGYKVDRILETHAHADHLTAASYLQKRLAEEQGHRPRIGIGKRIGQVQKLFGQRYGIPEQEYKDVFDKLFEDDETFKIGNLMAQAIHLPGHTPDHLGYRIGGMPSHAH

SEQ ID NO: 42073 - protein, 294 aa, A.fumigatus
DARASSDRLWDLHANNSSIDQCEGLVAFEYTNGLVRKPNTLVFIGGLGDGLGTVEYLTDIITALEYTPWSVFSPILSSSYSGWGVGHLGKDIDEIARCVQYAREYKQGLFGAGKIVIMGHSTGSQDVMHYLSCANPRPRHPVLDKDAAVEPPKRPPVDGAVMQAPVSDREAITWVIRDGTDRDGPGRMREIYQRTIARARSTPYEDDDTLDTILPLSATTRIGYPSSTPVSSRRFLSLASPDSPEKPEEDDLFSSDLTDDQMQKNFGHLGSRGLLGSKLLVLFSGKEQSVAPWG

SEQ ID NO: 42074 - protein, 87 aa, A.fumigatus
RQEGYKVWEAHVTINSKEQSQCYTSIRRASTISCSVWPECRPYKRTIRTEAVEISERQASRSNYFAYGYTGIPQACQSIAGSYRTIT

SEQ ID NO: 42075 - protein, 179 aa, A.fumigatus
ILKSAMARPKVHPANRLRAYEACLFCRTSKRRCSGSFPCQNCIRKGQAHSCMPSRRRESFSASRQPNTPDAPSGPVTAIMPSQVLSSTDSQSHASLETSVDQGLASPEAQHKTRPRMLRSLQGERGVCVCVVTDDFTPKHLSVDMLSSVCGQGCVAILPATTPRYCHPTHRPVTVLTQC

SEQ ID NO: 42076 - protein, 501 aa, A.fumigatus
HRYSYAKPSRPSRAYIHVTSSEHIAPLSDKVRQTSFVDARNTFNDPVLLGPPSLEFAPYAKIPGSRVRKDARQGTIDQDPEFIAFLESLTQPITKPTTVDTPTDAEEKKETVTTTPLVQYIKEKKANKAKEASSKSSRHAKGEKESKSEKVQAKKLLQRQDKDAALAPTGDKAEKKSRASDKASKEAVKAANRAANAAAKQAAKPAATQNTSKDTAQPASTERKRERNNIAVAAKILQRDLGLAPSGGRRRAGKGGSTETDSSKKEPDAAITADSGKKDTKSGKPMSPSTPRSKANATPPSGEPAPSRAQSGPNAGPTSAPSAQKQSKSAKGKPAAPITSPTATQAFLKHANPSQGVTEPLLETAFAPFGKILKVEIDKKKGFGYIDFAEPDGLQKAIAASPVTVAQSQVVVLERKANPGAEKTRGKGRREQPAPNNGSNSNSNSNRGAKQGSDGGSGPATPSSSRGPRGGRGSRNKGGSKGNGANASSNTPSGKTGGETK

SEQ ID NO: 42077 - protein, 84 aa, A.fumigatus
ILSLTPSDFPFVASFVRTRTMVDNKIPEPGPAKLRRNAGPDEWLEAAKDCKYLSEQHMKQLCEIVKEYMMEGESAQGSRDTLRL

SEQ ID NO: 42078 - protein, 111 aa, A.fumigatus
QSISEESNIQPVSTPVTICGDIHGQFYDLLELFRVSGGMPDGSEAEAPKTQSAVITSDDIEPPSTISDPKLRKKLRNTFAPEDGSEDSSASQRDRSSSVFTTRLEGTALGV

SEQ ID NO: 42079 - protein, 423 aa, A.fumigatus
YNKNLVITRNLDCLEYLVITRFYYTRLGPSAGLGEYPAAVIKTAFSPPGKKDFFLRHQPSLLSARMHLPKLFASGLVLLVVPSAVTARRGGGGGGIDTDTSSDGDGGSSSAPGGTSTIGGGSTSCGPTTEILYKSDLVPMNSYNWTSKGASNSGTNPTTYDGSYFQGEAFLHWQFTACRPCHNSSGTVRMLRYAWVGPQPPYPTGPTNPIIIGFKAWHTNDALENITFSYDFLHDGLYCPTAPDLVKIQTSNGWTDYQASTDIPRADRARAHDVFDLDLALDAERPDSVRFNGSMVPGLKPPPTYTVEVLLPASACNRQSRLSLGYGEELNMSGSLTNTTLELSLAGVGKGSYASGSGIMLRAMFNITFSGTFDSGNSTRAVAIKPDTQPMVFWVDNGAMMHGCLSWMLKLMFIGWVAWFVCC

SEQ ID NO: 42080 - protein, 109 aa, A.fumigatus
QPNCILVSCLAMSIRRTSATAHNAAIKDRSQAVAAQVAEQQGWLEKKLKPKKVTARYPFKGAPLLYATCAFGSLGDALFGYNSGIVPYKLDGRSAPHANGNRYHVRLAG

SEQ ID NO: 42081 - protein, 332 aa, A.fumigatus
VSEGPRQRRTMRPSKTARKLWQRRLQSNKAGWRKSSSPRRSLPDIRSRERLCSMRHAPLEVWGMPCLGTTLVLSPISWTAGVLLMLTAIGIMSGLLVNPVFVSRFFKDYGGADGTTNAVNPSITGISVACLQASAAVGALIAGRLGDIIGRKRCVRLGGFIYFFSAFIQIFAPDFATFIAGRTIQGLGVGFLSMTVPIIQTEIAAPHRRGLMVGIEYTFLIAGYMLSCWVDYGFNFLLPGHMSWQGPFIVQIILSFILLAMSFFLPETPRWLAKNGFMQESLQTVADLHSGGDTEAEHVQRVFLEIQEAVIYETNLGKSSWTVSLTTILWLR

SEQ ID NO: 42082 - protein, 97 aa, A.fumigatus
HDEQEMFTRYRKRTIVGITVQMFAQLNGINIISFYLPSTLASAGFDNRKSLLYTAANALPYTAATIVTWWLADKWGRKPLLILGGECLVPSRNHMAS

SEQ ID NO: 42083 - protein, 159 aa, A.fumigatus
LFYPSGLAMAVLLGIVCAFTQANLDITVKANGQYAFVMLYNIVYGFTWGPMPWLLPAEIFPLRGRSKGMALATTSNWIFNFIIGMVSPDAFAGIHGYFYVVIAGFCLFSAGLVYFYYVETANHTLEEIAVLFGDQAFADGDGAVMEVADVKNDHGKELV

SEQ ID NO: 42084 - protein, 68 aa, A.fumigatus
  UNSURE (33): Identity of amino acid sequences at the above locations are unknown.
SECYLCEASKKRVPRVLYQVEHCACESFHLFVXGSMQCAAECKPAQYITYGKDRAPYLQQGFSDRRFP

SEQ ID NO: 42085 - protein, 1686 aa, A.fumigatus
  UNSURE (847): Identity of amino acid sequences at the above locations are unknown.
ASPLVWWLVHHHLSHYPCARLSIFFSLSEFVMASGATSASSEARELSLISKVELRIALADTDEKLEGLLNTYLAPLLLKLGSESHAVRSKVIAVCQHINTRVQAPSIQLPVAALLKQFKDQKSQLIRHFDLLYLQQGIDRLSPNARIDILSPLLQGISEIGATNQGAIIFNLVLRLLPLLNLPPKGSEEDTRLKSTLCLSDQDRSFLSSWFEKLLLLYPAEKDATTCPGLSPAEYTFLNKGLPADETWNPASNGGLNLTATKVTALRFLTSGAFTDSERFIPALIASADVNSRVSDLGEEILKRFIPDLEHPDVVQKLYSLYFGDGTVDGAQPARPPIQLKILVFLGKSIVATKDTEKVIRLIEEGLLSDKARSSQGLQASKLRTQIFTFTTWVVRMGSPSDLKLMAPKLIAGLWDFIQSQGWPSPAASGQRLPASDLSLRGLAYESIGILVPKVDFQAQDDQAQFSDFDLIKWVFTSLTSDDSGPQIFVSIEQALGSILNSSVDRWNREFQEQIRPFLVHQMGNLPGDEDPITGFKIVRRSQYAAVRFSNRFLPYSDVVARWIDLMAVARGSELNQEVVEEGKKGLHPYWYRLLNPSKDRKWVASTAADETEQAWYNFPTFSDATRFLLGSPESARSAVAPALSASEALSGPYRTALPVAIAFLRNILLWEALSASGNIIEIDQDWDVKLDVLLTSDEGARRGLKQYMQSSDKEPILLFLTSALTGLTSDKRLGLQRCGEHFVSICSLASNDTVGAMVPQTLALKASVSSTDQEIQNKAAQALGILASHPAFSDADIRSLLSDLSDSVSSWKPAIGEALLKIRGAILAIGYILSRLAFRSALHRAXDEQVERFTSTVFDLVENSRDSFLRRFAQVALGLLSLSGILSPAMISDARWKQIKEKLTQDAKSESDTAIATLGLLALTFARSSPDHALFKELLTSLYELHEIRSPEIHFTVGDALSSAVVGWNSKSLLRQFDVDEEVPHMTISEKVLAEMTDKIIADCTASKPSLRKSSAIWLLCLIKNCGHLAEIQSRLRKCQATFTGILGDRDEVVQETGAQGLGLVYEMGDQSLKDDLVRDLIESFTANKSNLGGGKVHADTELFEPGALPTGEGSSINTYKDIMNLASEAGDPTMVYRFMSLASNNALWTNRAAFSKLGVSTIFSDSSVNGYLAKSTKIYPKLFRYRFDPNPNVQRSMNTIWTALVKDPAVVINTHFDEIMDDLLTSMLAGREWRVRQASCAAIADLMQGRQPEKYAKYLDEIFTKAFKLLDDIKESVRVSALKLCQTLTNAIVRTLETSDLETKRANAMLASAIPFLLSDKGMESSVQEVQGFAIGTLVQMIRKSPSGPLRAFVPRIIEQFLNSLSSLEPQAVNYVHLNADKYGLTGQEIDKMRLSSIRTSPMMEVIERYLIDMLDDASMKEFAPRLEGVLRSAVGLPSKVGCSRVLVLLSMRPMLFRPYADRFVQLLSKYVVDRNETVSASYCTSIGYLMRLATDDQVLKTINYAKNLYLAAEDANERVISAEILHSTSKLSNDRFMAFAATTLPFVFISKYDTDTHVREVFDNTWQDNVGGTRAVSLYLKEIASLAAENLDSPRWAIKHTAALGIANAIMLLDADLDLATSQSLWPVLEKALAGKTWDGKEAVLKAFMKFASQAQKLWQENKQLSDSMKVSLSLAYRVYLGG

SEQ ID NO: 42086 - protein, 393 aa, A.fumigatus
ENTRVSAYRQRLRAALEIQHISIFFMGNAFYQIRTDPKLTEPDSEEFKRLEKRETEAYEEAKLIRMEILSDVSRKVSRYMKVIREKSEKKQFVVIPKMKPQLYSKGLEARRIFDRYEEFCEVMNKHAVQYNEWRDIMVKLLSQSLIDQEDESELEGNEYERSTKHQDEMYVYMEALRAMFADRHDALTGQQNVLIAHEVKGGIIQAQQGEGPSPALFLSVMNTRSALKPAPALGSLRGIISELRSLATSLEWQGSGGSSRALAELELVNSVLQHAAKMAAEQNKVSSNLEREVEMFRDTMNNRLEYYRQLQQISDTVAPYDEESVGKPLDEELYGAKLKQENEIDAKISTLRSKHRYLLHLRDDSGADNASRICVICQSSFEIGRCMCSIPKR

SEQ ID NO: 42087 - protein, 186 aa, A.fumigatus
DFVLLTFIGVLTVCGHKYCKDCLRIWWNQHRTCPTCKRRLKVNDFHQITYKPEEFVVQEEKTPKLESGRSSNSFIYTDISSGTLKEIKNIDLEASFGTKIDTLARHILWLREHDPGAKSIIFSQYKTFLEVLGTAFSRFKIGYSSIDNADGIERFKSDPAVCFPKPHCYCFFTDNCLAGRMLLSTC

SEQ ID NO: 42088 - protein, 91 aa, A.fumigatus
EAKWPGQVIAIREAKRNNPIYRPHGLVALGGVARARSDVDFMPDALNIVSRVLDEVTEADADSMDIDSGSGQNSKYVYKICSPFSVFCRLF

SEQ ID NO: 42089 - protein, 138 aa, A.fumigatus
RTAIKSYLEEMTPLIEKAVVHGTRKVQISLYEELGKLFERFRKWATAGNGQKPEAGELQGPLVALAQKMLCREIDMSIENIRMGRAQAAAAYVALSQQMELDVTQALQDSVKTWKDSERSGLVQQVLNQILTDLAVLW

SEQ ID NO: 42090 - protein, 68 aa, A.fumigatus
RKTKTKTSLSANQNVLQSMDELYSSTDAMPDLTSYNTAERFLGTQGAQSKKPDSRPKTRLAVEFQPAL

SEQ ID NO: 42091 - protein, 199 aa, A.fumigatus
RGSRATQRYVSPNPTVTVSLLIIALQVECFFLHAKAQSSGLNLVNATHVFLCEPLVNTAIELQAIARVHRIGQHRPTTVWMYLVSDTVEQSIYELSVSRRLAHIVQKEKVKEALDDPGAVFKNLTETAIDSANSLEVQDATLAKLMTKGTAGGELVKKDDLWQCLFGNATQKMDLRADGEVARFLRGDAAEKRRAAASS

SEQ ID NO: 42092 - protein, 66 aa, A.fumigatus
DAGEYDLRSALGVSLIMDKPYPSVVVIEQLSGMMGINPVHDQATGQIWRAGFFSHHSLPVAFDPDA

SEQ ID NO: 42093 - protein, 67 aa, A.fumigatus
DVTKQRKSASGIASSIKLLQSTAAIFRVLQKVTYQGGWAFGKVEMWNRSWSHTRNSLLLGNIQTLAD

SEQ ID NO: 42094 - protein, 469 aa, A.fumigatus
GTDISVAAAIISPFLTEPTLLSMQCYALMSLYLMNASQFRDAYSLLGTAIRDSHSVNLHEEPSERLQPKDRIAQRRIWWLLFMLDIKCSQQLGKPVAVQTATITCALPSVDELTTMPENTRVCWKDLHVSTYFIHAVKFAVSLAEIQRLISPSKLFEDTNNITALEQRANLLATSLAGLEKWSNELPEDLISPRKNTGHAEAMSTAESPIVLELGAPSWLHHQRVLLEVYYHNAYVMLQRPFICFPQPSNSSPVQQPQTDHHARSSLQHAITMIIIVHDLCSSSDLFFGWPAILHPLWNATVTILGFVVANPSSSRSRRAIQWIFKALAVFEAFAATEPFAARAETLTKSLVTKLNDILTTLDEKSEQEQTNDRGRIAPGLTLQQSPDSVPSTTPSSANPVDMLRGSLAGGLEHTFDNTFFTNDSLCSSIEAAEINTWAAYQDHLDIWNGSHSDKALDATYTLGIGNTP

SEQ ID NO: 42095 - protein, 213 aa, A.fumigatus
FSDIPHGISTHRIKMNQIPVFAGLGSDALFSERTLGTAAEDARTPEGQIILRACHSIFLKEVASVTHSRRLPSDINLDDFVEPESLIRPRQCNERNSIIQHVSLYTIQLLRYLRYSKEKPGIVLGVAGFCAGLLPCAAVATSKTVIELLARAQDFFYVALHLGIRVESYRQTMVAKEACSPDLPCSLVVDGIDAHHARELLDDHNRRVWLVHD

SEQ ID NO: 42096 - protein, 349 aa, A.fumigatus
  UNSURE (85),(108),(122),(123): Identity of amino acid sequences at the above locations are unknown.
RNAQGTFVEGDSRGEARNAAQREEMAAAARRAQLLAEQERLSQAQAQAPGLPSTANWASAGSPATPTSTGSVWNNKGQATTTGGXAKKTLAQIQKEEEAPKQRLAACXAAAQTAAVSSPATXXRKRYADLGSQGSCDSPCCRNQLRVLGTTVGAGGKPKPPPAAPSGPRATSGNVPPAASPAKPRAVPVASPRPVAVGSAPPSNANRALEEFTKWAKLSLGKGLNSNINGEFCIYAIIENKQLMVILVDDFVQQLLLLPAEAEIISDSVYANSQTLDGRRFAEEFIRRRKLADKGIVDPVAPSALADQKNAAGGGWSEVAKKGSSNAHREEESSNAAFKVVAPRKKGKR

SEQ ID NO: 42097 - protein, 187 aa, A.fumigatus
LRLPRRPPRCRRIQIPQRQVRRRRRVRPNGQRRPVGRKLGIRKRTRASLLAQQPRPRTQNRRVRMHRLHRGRDPQLAQPRRVLRRRQLQMLDAMPPAGRAHRGQRVDCQPHRRIADRMQRALQARSVRLGHYGPQHVGRPQRLAVRRPVTIGSRSSSSSIRQQQRRGARIHHPVADDLDARDAEIRR

SEQ ID NO: 42098 - protein, 61 aa, A.fumigatus
TLRCHHRYCYLHCDWIGLGYARLILTCSTTDVHPMWEGPVRYAELDHYYDGAREMEVQDCR

SEQ ID NO: 42099 - protein, 226 aa, A.fumigatus
QPQLIHHTIGNFNIQPDKQAVTRINDSLSTLQQSRELRMRDAESALRKLSRNLHALTAQHEEAVSSHDSAKHAAQMVELDTKKFRIAKAATELEIESERLEGELEMLKERLAELEAQGLEGDEATRREREADDATMWVVLLCFYWRVLTDYATDFASKSTGPWALISRRTRPATSARPLFATVARETSTWSIWTPSSRVFSMPITFGQPCRVELCNLVMAFGFLPG

SEQ ID NO: 42100 - protein, 330 aa, A.fumigatus
KTTEKMPGFGSVRGESRLKGLFSKDSSEDISASIKEKPSLSNLERLAEDQEEKRSQSPWGETVKTRTGRSETNPFAEDTRSGSAALGGSQDASAPSQTADQLGFSAFGMTSSIPGFRELMQSHENSRNPTPSLLQGQEPTSPTNTNPYQSPQGERIDADDVETDGSDIQNTHHPGLSGLRDSAGPFSSMRRIGSGMDLPSIDRSQTSSAAGNRSYSGLGGLGGLPTLGGASAWSSGVVGTPTRERSAFSTGFGDPIFGTMADLQSPSLSTLGGGGIFSPGITGTGSIGRSSKLGSLFPPAMQEQMQGDQARQGSLEDGSQHQGRSNYAPI

SEQ ID NO: 42101 - protein, 566 aa, A.fumigatus
  UNSURE (342),(367): Identity of amino acid sequences at the above locations are unknown.
IFQYTDPFCEEVSQGDKAGQPTTTSTSQTPVSAIGSVPASMASEAPQPSQTPGQSGSNAGSVPPAQQRTMVMPDRMRWIYRDPQGNIQGPWTGLEMHDWFKAGFFSPDLQIKKLEDPEFEPLAQLVRRIGNSREPFLVPQIGIPHGPDPNAGAPWTGSTTAQPPFPGSFPSFGTTLTAEQQNALERRKQEEQYLMARQKEHLAQQQAMMKQMQLQGAVHPGIHPQLQHHSSAHSLHSQPSFGSIASPIGFQPSPIQGPMQQQPPQSVAGFFDAAAPLRQGPQMVGADLVNSPHQLAPLLDRLNISRPDPFAFGSPSYFAARQPDNLFHSQQVATMLQDRARXQQEQEQFDSTQGEGIFEQQAREDRXRQFHALRAQEGDFGMQNAQGHPSHHATEPSQQQEMAPIGSPQKTGTSSGVVDQGTAPSEEAPLTLSQQVQKAASAQRQQQEQQEQQQQQNEQSHADSAWGAKDDTAMPPPPSASPLPAPAAQRNRQNVAESLAANSRSQTQTPVEAPTTSIAPWARGGNEMPKGPSLKEIQEGRLVMLLRGKKWPLPLVVRNSLPSRSV

SEQ ID NO: 42102 - protein, 257 aa, A.fumigatus
TKCPLPHPLVASMAKSHFMFDPDFKNLNHGRFPFESRVSLTSLTPSLPPGSFGTYPVAVQTALRHFQSQVEARPDPFIRHIQPQLIDEARRAVASLLNVPTNECVFVKNASTGVNTVLRNLVFKQGDVLVYFDTVYGAVEKTLVSLTETTPLQLRKVQYQFPISHDELVRKFLEVVASATAEGLTVRVAVFDTIVSLPGVRFPFERLIEACRAEGILSVVDGAHGIGQIPLDLGALQPDFFTTNCHKWVFFFSFLNL

SEQ ID NO: 42103 - protein, 598 aa, A.fumigatus
AGSEDGLGSIDAAGCAGRGGCWGDPEGVGAGLWDLCACVCARRVVVDPAECAGLLGEERFRVACRCAERAMQQAGEEVCRAKVVMVIFPTCIYFLRCIYIYIYISLHEFCVSNCLGTAVHPPSIKVCLAHRGLQQLLGLPLHLQDCKIRLLPDLQAPREPIRQSTSTPSRPSPPKPPGSSDSLNCGFTVTVDSGSLADRRVVAVYRFLSGRCGAVGESVPMASGARWAANSAYANARAHRSSPSSRGHARRIAGSACTGCTEAVIPSWPSRAASSGAVSSRCSMRCRRPGVPTAASVSIASRTVASPIACSAHCRPAASALATTARSMSAGHSGSQFVGPSPSAVAAAAAAYGSSSAAVHASTTPSQMTLMPAMRKSGDERALYTACSSIARSTCARHSSTVAAGVIIQCAASRSDTFSVCRSASIVPHTFSSVAISTTPVYPAALYARTALRTNSIFSSAVATRATCGHTIFTAAASESNPLGCPSSPRWMTPPAGSGVSATPSSRSAAVLHHALCRSFESMKMGRGSRSSSMLASACPSVMECIHPRQKRRGACGSCAAAVLMVERMSERDLQCPRSILERPAPNRRRCMCLLSLC

SEQ ID NO: 42104 - protein, 230 aa, A.fumigatus
  UNSURE (13): Identity of amino acid sequences at the above locations are unknown.
LRWLYTPRGSAIXYVPLRNQHLIRTTLPTSWGFIPSPDSPTTAPSLMRSSGSGKSAFEELFEFVATTDDTAYLCVPAALKFRSQVCGGEDRIYAYLEKLAMEAGDIVAAALGTEVMQEPGLKPGEVSQLRRCAMATVRLPFAVSGSEQDPKTASARLTLQAAQAAEVAGEIQKALVRDYGTFVPVFAHGGWLWTRLSAQVYLEKSDFEWLAGVLNELCNKLVKKFAEPKL

SEQ ID NO: 42105 - protein, 62 aa, A.fumigatus
LCDRLRLKIYRSLGIDIEADEAGNFSKAVIRNSRKGDVHVVNMDPKFSRFFYANYFWSTMQG

SEQ ID NO: 42106 - protein, 226 aa, A.fumigatus
YRWCAAWTLYSTGWPTPTGMARIRIRTRIKTKIGTPPVRRMKRSPTSIVRGVSHPNSVQLAGYLREMRMVRSRWHHLSAPSESTSPFSFSVYGPWLTSFDSILELFRADFGGGMEGGGVRVMTGPNPLAMLSTLLNFDRHGDAVYSQEELDRVISQLIDQNLNRTGAPPAPQSAIRALPKKKVDEEMLGSDGKAECSICMEQVELGTEVAVLHCNTGFTIPALKPG

SEQ ID NO: 42107 - protein, 618 aa, A.fumigatus
HKDKRHMHLLLFGAGLSKIDLGHCRSLSDIRSTIKTAAAQLPHAPRLFCRGWMHSMTDGQALASMLDDLDPRPIFIDSKDLHSAWCNTAALRELGVADTPDPAGGVIHRGEDGQPSGLLSEAAAVNIVWPHVARVATAEEKMEFVRSAVRAYNAAGYTGVVEMATDENVWGTMLALRQTEKVSLRLAAHWIITPAATVEECLAQVDRAIELHAVYNARSSPDFRIAGIKVICDGVVDACTAALLLPYAAAAAATADGDGPTNCEPLWPADMLRAVVAKADAAGLQCALHAIGDATVRLAIDTLAAVGTPGRRHRIEHLELTAPEDAARLGQLGITASVQPVHADPAILRAWPRLLGEERCARAFAYAEFAAHRAPLAIGTDSPTAPHLPLRNLYTATTRRSAREPESTVTVNPQFKLSLLPGGFGGDGRLGVLVLWRMGSRGAWRSGRRRILQSWRWSGRPRSCWRPRCARHTLMEGGCTAVPRQLLTQNSCRDIYIYIYIHLRKYIHVGNITITTLARQTSSPACCIARSAHLQATRNRSSPSKPAHSAGSTTTRRAQTQAQRSHSPAPTPSGSPQQPPRPAQPAASIEPRPSSDPAHYQTRQTAAARSPWHSGAAD

SEQ ID NO: 42108 - protein, 143 aa, A.fumigatus
KQRSTTHIVASSASLSLRVASSPSSPCASNSASLSLSISSSPSSLSLSISSSVAALAIRNFFVSSSTICAACFAESCEDTASSCCAVRACKLRESLRSADSASRIRSSRDCCNVDRESLMRVTACLSGWILKLPMVWWMSCGC

SEQ ID NO: 42109 - protein, 74 aa, A.fumigatus
GLIKSNARTDQQEGVRLLSEIFRAAPERRRECLYYLALGNYKLGNYGEARRYNDLLLEKEPGNLASCHPRFADR

SEQ ID NO: 42110 - protein, 184 aa, A.fumigatus
QLGHRSRRLYIRVLSFFHNFFFNVGHYFVIHCNMKTVFTNGLIVRGNGSSQSEPVLGCMVVEDDKIAYIGAENDESVAQAKQAPGVEVVDLHRRTVIPGFIDGYVSLIHLFNKNATLRFPYGFATLATNTKTKDTCISSCSAQASPKSTSGTADPSPTSALPSRPPPHSSRTPPASSAAGGCTP

SEQ ID NO: 42111 - protein, 63 aa, A.fumigatus
KVSIIRLSIAMPTLNYPDSSPLKPAELQVLRAQYEKEGDYVGIQTKFNYAWVCRLLFCFQSTG

SEQ ID NO: 42112 - protein, 210 aa, A.fumigatus
FHRDCTNPSYVLGIFWISANRRYQIEIPPDTEDSSSRPTNDSPPREENNQPNVNPWADHNPWANEEGYGGDDNTWRPGFSRRTYRSPDGRFTFTTTTTTLGGGGFHMGRSMDQRQMPIDPLIPVVRSLDTIFHGLADTYRHGQNQDQNQNQNQNRNATGQENETVADEHRARSESPEFRATGRLFARDADGPQPMAPPFGTLGEYVAIFV

SEQ ID NO: 42113 - protein, 159 aa, A.fumigatus
GRGAAGPAGDHGLGAAGACGPGDSACVAAAAGRGAMRACVCVCRVCGPPGAAGHWDGLADGAAPAAEESVYGDNAAVGEGAGVNCDGKPAVQAVAAARRFRRRRPARRTRALADGFTGSLEVGKKADFAVLEMEWEAEKLLEASVCETYFDGRRVYSRS

SEQ ID NO: 42114 - protein, 193 aa, A.fumigatus
LMTSESAKLKHHHHHHSDLELPNPHAHQGPEETFENLLMMLEAQFGSNIAPIERPRIPSGIRANRTTKADPSVSAAVKTKSDAAGETPAESQEDESTEEIEAAELARLQALGIPYPGIEIKVDKHVARVWLENFEVECANTVLRDRVRVVIERAVETVSSMWGEGHPAARASNGTQGNKEVAVSKSNEIEARA

SEQ ID NO: 42115 - protein, 181 aa, A.fumigatus
LIVFLQCFFAPILTTLAPSKMSRRAQVEEVYDSDPEEVAPSDPSASILSPAAIPPPGASNIPMRPAPEPRREIPKHFQCLYPVYFDKTRSRAEGRKVGIELATENPLARDIVDAVQMLGLNVGFEPEKLHPKDWANPGRVRVMLKDEDGNLINPKIKNSMCTAPGYFSIPRFLSPLSQIAN

SEQ ID NO: 42116 - protein, 122 aa, A.fumigatus
LAVEHHLYILVAQYLKAHPTTEESPYRLRIRGLPMPEKLPGAPPAPRGWKIGKILPIHSPAYSGGGVSDNPLKDAMAEMQSMGGMPGMPQIPGMPNLAGLMGEPSAASGSEKKKKDKKKGKA

SEQ ID NO: 42117 - protein, 99 aa, A.fumigatus
RRRPSPDRGIMNTDPTRNLPSYGAPNLGPSLQLQPDTNSPRPFFCSPAPSRTATGKTRRAAGRQITRNRASYSCHTCRRRKVKCDKVCASVVVAYIVVI

SEQ ID NO: 42118 - protein, 243 aa, A.fumigatus
PMSPWSHISQILVHGEKHQMMRLKSKLLSLNADKAVKVKVYTPANCDEVRIPFRKDKIAKVVGKLAQVAPPSDQDDGRLMSGVLVQNGFDLSLMAPDDLREYAGLTTTTITCKQHITLSSASMDLIRWALEGTFGAIEELGSNERSKVKEESTKAVNGEQEIKEEPADEEIPMEETQTYLVMGCVLIRYHSRTREVELEWEGNMMNDGVADAVMAVLLTVESSPASVKRMLILFSFTEYLDAD

SEQ ID NO: 42119 - protein, 100 aa, A.fumigatus
NPVPHSNIQKTDFHVPTTTTTLKRVPNNRCAALTHSISSVFFCADINNISAQQNVTTRASRGGLRLRPRRGRSLRPLSLHPFPCCNTSSRRFEYPNETGS

SEQ ID NO: 42120 - protein, 85 aa, A.fumigatus
IEFVKDKTTKEPFAPETAVAFHVQETGMKPVHGISLYAASGCVDGIRGDHVLLAPPYNVTKDEIDIIVETAGKVIEEVFVNIGII

SEQ ID NO: 42121 - protein, 112 aa, A.fumigatus
HRIASNTRSAVLHRDTRFIPKKAVGGKGSYIFLEDGTKFLDSTGGAAVSCLGHGHEKATQAVTNQLNQLAYCHTAFFGTEVSEELARFLCDSTGGKLSKLYVVSSGARPSQV

SEQ ID NO: 42122 - protein, 135 aa, A.fumigatus
SVTHTGSEAVEAALKLARQYFLELSPAQPQRTRFIARLPSYHGITLGALATGGHVLRCQPFEPLLAQNTSHVSPCYAYRGKKEHESDADYVARLAAELDAEFQRVGPETVCAFIAEPVVGAVSTPRAIHQSSPLA

SEQ ID NO: 42123 - protein, 211 aa, A.fumigatus
HADPNPDILDIKALGAVPVVPSYFPAHESHLGKNRSAFYSRRSDVRHGTCGHPCTHGKTRVLFPDLQTIGKALGGGYAPVSGLLISEKIVQAMDKGTGVFRHGQTYQGHPVACAAALAVQKTIKEENLLENVRAMGAYLENRLRERLQAHPNVGDIRGKGLFWGVRRHLSMRIERRNMTDAVNRLSSSRTRPQRSLLLQRLPLPSTSKRLA

SEQ ID NO: 42124 - protein, 340 aa, A.fumigatus
QRAYVARDGNRTIIYRGQKSGVDDFDWVRCMARPPRPLSTVVLDEAQKQAFIDDIKEYLHPRTRRWYSNRGIPYRRGYLLHGPPGTGKTSLCFAASGLLGLTLYLLSLNSKSLDEDSLMSLFSELPRRCIVLLEDVDSAGITQKRAEDDSVASAVLVEKDKSSAEEREPETKANKGVSLSGLLNVIDGVAASEGRILIMTTNHAEKLDPALLRPGRVDMTIAFGYADRDAMRELFSAIYSMLEGDARTSKMTSVRKASGQVQKKHAKATVTQRKRQRLSKEKIAELASEFASRIPEGEFTAAEIQGHLLNYKNEPEAAIDAVEEWVRSVRAKRKEKEQSK

SEQ ID NO: 42125 - protein, 1000 aa, A.fumigatus
SELDGDSSRADSPMQAQRGGEADWFYARREAVSAILGPDHISHMPDDELDALFEDVQKVRATRRGLVENEDDSDSLSSFPVRDKYMSNGTIDNFSLDTAITMPGTPGQQYDGEGQNGSDFTLQAARQDMQRHLDKQKEEFKNKLRIAEASDQDADELRLEKERMEEALRSTKEEYEEQLRKQKEAFENHMKEMGQPVPRIYENGFAKLDEREIRIATSVFPSLGPSTITSAWPEKILQHASLLKEAQVMSQIMDKNVSFQFAIIDHGHNMASSYDLVLNGISGDEDVVLEEAKKPCIAVRVIDSKQRVIHLWSIEKLHRRLQAMRQLHQYIDRPDYIQHFRLENPFSEPCSPQFSLVGDADIPLTAVFETRVQDFSVEVISPYTQNVVGIVRLSLEPSSAQAPSSTLKFNVVMRDMVGFAEWEGTDVHAQLFVPGISEEGGATTTQMISGFDESPIRFESVHSMSLPLSSPRTSALKICIYARVTQMHLDKLISWDEMRDSAELPPQKRKAPRIAESEFFSEERHDVFARVQVLELAESGEYLPVEVVQNNSLDAGTYQLHQGLQRRVLVSLTYNSTEGLPWDDLTNIRVGSVRLLDPWGKIPDQDLQTPDVPLKFVQEPAVKDNADGTSNVTLVAQWDSSLHGSLLLDRVTADKYRVQVTVRWDLVSSRLQDPVPFEVDLTLQIQGRTYVRPQSMFKQLFNSTRVVHSTVRMFSLAIRPVSAKRAADLWRMNTQNDYVKGEELLARWSPRKISLVRDYIAARKRRRRLAELNAAKGALSANSLAPSPVRSGRSTPLRSQELNERKTRLLRKYLDLWVTKTDPIEAILVRSNTEPPSDGAAFALRAKQSSLVSDDGSSVSNQELLKPRFIATIQTLPKNMSSLKSGYLLTPDDTNSHWVRRFVELRRPYLHIYSVPDGDEINAINLRNSRVDHDPDFARLLAGSDSGVSAKGRPNVFAIYGTQNTFLFAARTEAQKVEWILKIDESYFSNGASRASSNGN

SEQ ID NO: 42126 - protein, 150 aa, A.fumigatus
  UNSURE (29): Identity of amino acid sequences at the above locations are unknown.
TAIASVMAETATTAFLPWCLRRFYCKSGXRRLHPTWRPRSETDRDDSDGPLVEAPNLILHGDTYFLFYSTHCFTDPKYDVRWATSKSITGPYVKTGQKLFKTGDYGLTSPGGGTVCGCGDRMLFHAFCESNKRCTYAANLAINGDQVTLL

SEQ ID NO: 42127 - protein, 106 aa, A.fumigatus
RHLVVCFNPVENVVLLHECGLNNVPTIGIIDTDADPTQVTYPIPANDDSLRSVAVIAGVLGRAGEAGQKRRLEEAKSGRITYRLPTLKELGIKLPENMAETAENKQ

SEQ ID NO: 42128 - protein, 112 aa, A.fumigatus
ENQKLTIRRMWLTQSRIPSGGISTFGPLIVKAFGFDQFKTILFNIPFGAVQLVATMGGAWLATVIKMKGPIVILLCLPPIAGCVMLLQIAHDAEHRGALLAGYYIVSHEDPF

SEQ ID NO: 42129 - protein, 103 aa, A.fumigatus
NQPRHVLCTGSSLHVSYLLLLCGTQALTLTFSINLVYLWFLNKKHAQKRVSMGKNATIVDHSMYAVGDGPADKEGVPVQQTATEDNAFKDLTDWQNEDFVYVF

SEQ ID NO: 42130 - protein, 73 aa, A.fumigatus
ILPRLRMCCSTSVSSSWFADTYCHKQDRYIPIFDPEYDTFDSVRSRSSILLNAICTIGSRIEPSNYHLLLYAL

SEQ ID NO: 42131 - protein, 207 aa, A.fumigatus
AREKYFTHLELQSGPGKHKGTMSLGAEPAYSKGRDEELIETVQSAPYQGHTQHSETKKDDALQLIEQVGHSTVLTAENNARVLRRIDLRLLPVLLGIYFLQQLDKSTLSYASVFGLIEKAHLHGKQYSWLGSVVYVAQLVAQPLIAYILVKVPLGKFLAATTLLWGVSLTCMTAANTFPGLLVCRMFLGLFEAGVGERFHFIVSIRH

SEQ ID NO: 42132 - protein, 549 aa, A.fumigatus
AIMPQKEFCPKGYQEQPSGNAAADPSVYLRSENSKDCSFDFTFEPIRPNLFRVTFSSQDRPLPPYPSISKPNTDLNGIHVSVTDGSSSKTIEVGDVTATVEWSNTPIVSLSWTGEEKPLHRDLPLRSYVADATGIAHYSEHDRNALHVGLGEKRAPMDLTGRHFQLSATDSFGYDVYNTDPLYKHIPLLIKVTPAGCVAIFSTTHSRGTWSVGSEIDGLWGHFKVYRQDYGGLEQYLIVGKTLKDTVRQYAELLGFPLLVPRWAYGYISGGYKYTMLDDPPAHQGLMEFADKLMEHGIPCSAHQMSSGYSIAETEPKVRNVFTWNKHRFPNPEDWIKKYHARGIRLLANIKPFVLATHPDYQKLVSEGALFKKPDTQEPGTMRLWSAGGGTGGDGCHIDFTSSFAFRWWYEGVQSLKRAGIDGMWNDNNEYTLPDDEWQLALDGSGVTEQAKTQRDKSVGLWGRAMHTELMGKASHDALVDMEPKYRPFVLTRSATAGTLRYAASSWSGDNMTSWESMKGANALSLNAGISLLQVRLHHSRLSWTSIAC

SEQ ID NO: 42133 - protein, 316 aa, A.fumigatus
KTKTDCLSSTGPQPSPELLLRWVQLGIHSPRFAINCFKTSPGNTAVGDVIEPWMYPEITPLVRDAIKRRYEILPYIYSLGLESHLTASPPQRWIGWGYESDPEVWTKALKSGEEQFWFGDTILVGGVYEPGVTVAKMYLPRKANDEFDFGYVNMNSPYTYYASGQWVEIPSQWRDSIPLVARIGGAIPVGKPVQTRVPGDETEASLAVDELDDYRGVEIFPPRGSSHGCVFSYSWYEDDGISLQPKMSTYTISYSSTEEKVTVGFNRDEESGFVPAWKDLDIILHNGDERRVVSDGWPVEYKGKDSRGRVVYTLKH

SEQ ID NO: 42134 - protein, 250 aa, A.fumigatus
SRGRLPGRQRAPPQEWHPARGSHQLVILAQHPHCGPEQRTYIPLSHRVVACFSHCPSPSSYSTSSRKESRPSTRPTPSPSTKSARSPLKLSEAATRISRDGQASPRRLHHAKRPGSSTPASPSISESTTSPPRRRPMISSPLQPAGPRRSTTPSSCSRATPRKVSRPSTASPVPLPSGMRTFLPHRWSPTRRPGRSATMTPSSWVTSSARSSSRRVGSMRLALMSTMPMATRRRSSGTAVSSGARTACGP

SEQ ID NO: 42135 - protein, 191 aa, A.fumigatus
PARGAAGKQTVTGTCECVSYLGPALGGGHGWLQGHHGLVADQFVSANIVLANGSLKTIDAKSDLWWALNGAGHNFGIVTSVTTKIYDIQHADWAIDTLIFSGDKVEAVYQAANEHLLKNGTQPVDLINWSYWLNIPTADPNNVRISPYPTEWSLVFLTALARHPILHHPGRSQDRRPGLHQALPRNRPALR

SEQ ID NO: 42136 - protein, 776 aa, A.fumigatus
FSPRNVAAAFMDRCSAYNSADVNGRDCMEMSLSEKIALWDRMIERGAECERGLDSMMDIVQRRETPEGEADDEDQEDDDDIPDLIVYRKIVLGAPAFKTLVATLQRECLLVTPELDFMREIGQKLLECLPLSPRISRRRSAESFKVKCTVSWDPITFLITQEYTPQPATAFETAITLTGSNRIAQALPCGQYLSQTWPSTGEQIMGLIKGLIRKGFHNPQSGILHDGTEIVAELQGAIGDSSSMLYSEVTGTAYSIIEVVEQLAWLGAALRSSPIESGVVYCRPVVDCSWAVQDEGEATRRVEYHCKIDYTLRMGEDNPIHLNGQCWHHLFRNPVVVEGYPIARRPKSTTDTGLEIPLNMMAGLAQAHRLSTFNSRTVLKGWSTMLVPTEQHDGLVFWHLMHHPEGKRMSFDTCNTFPPTNVCLPALEKARHVLGWCAEMQFFGGAADASCNVRRSRLPETSEDCMLDKAYLSSGHMISGGHPFSIGRKDIPLHISRHSYIRKLRWIAQKFVILWDEGDKRGWLVNGTSALLHLVRAAMKQASVDRFQSYLLFDADKLRESRRSHEPTAAIDVLMDPSNRALKVYHEKDDSIHFESQVEHFYDLLEKIIDHQQNTAGKGGRNCNTIPRAYLEGWDFHELVVEVDPVHPRVAVLESIGKSWVDFARSIHAVTLFGRGFGEIIKPPTGTCWQWARLPKWRYYLSACMSDLKDIMQTRGDPDSIPMELVDNILWQNSDSFLAPCRCKGDDGETHSDFAQVLLPSSMAREMLQNVTRTAD

SEQ ID NO: 42137 - protein, 451 aa, A.fumigatus
NSGGAVIFGQNREVEWFWDDTGEPCRKEEAIPSQAFPGSPSHDSGIGRSVASLTSTTGESMAGLCSSQPSVNGLSDGPQPGNAGSEGTGVLSITTLDERLQHLVPEDYKVGIVCPLYLELMAVRTLFDSEHEALTITDHDPNYYALGRIGRHNVVAACLPDGEYGTNSATSVAWNVKRTFTGVRFCLLVGIGGGVPSSENDIRLGDVVVSRPTGTLGGVLNYELGKALGKGGFQPQGCLPPAPGHLMSALSDLRSDPRLSSTPLQPYLEQIASKNPAYKHPGSGKDRLFTSDNIHVEQSGRRGNCESCVSQGEVERPPRLSTHPKIHYGLIASGNKVVRDAEMRDQVANQHNALCFEMEAAGVMLALPCLVIRGICDYADSHKNKIWQEYAAGAAAAYAKLLLSRLRPSPGQLEDERAECHSVSRLQRPKRARTVSTAAIEPSSGLKKVRR

SEQ ID NO: 42138 - protein, 211 aa, A.fumigatus
PVILFYIIQEGVKTVDPAYTKPFHEIGPLSAEAIGGSYTDLAGWTGIATTSPPCQKAGLVNPRFPIYLREYNVPAQKTAYDIFAAATRGSSAFNNSIFMFEGYSTQGVKAINSKSSAFAFRNENLLAAPLVTYAPAGPERDNDAKQLGNQLRQILFQASGLNEIGAYVNYAYGDETPQQWYGSEQWRQDRLRALKKKYDPAGKFSFYGPIA

SEQ ID NO: 42139 - protein, 414 aa, A.fumigatus
LSVQRAVDVRAREAMETPARSPFANDEYTVGWICGLASELAAAQSMMDKVHGEPQTPPAEADNNVYMLGSMGKFKVVAACLPIQHPSTEAVVKKMLVTFPRIRVGLLVGIGAGIPNHDNDADICLGDVVMSSSPKTGGVISYDSGKALADGSFESLSVSNSPPMPLHSASAKLQSQYKMEGGRAADYIEQMRRRFPQICSMKGSDPGDPADRLFQPSCPHAGGDSCTECAPSAEISREPRPDGIPRSHYRTIESGDRAIKDAPTRDLIQDRDGAIIFERETTGLMDNLPLMVIRGIGDYTNSHKEVRWQAFAAAAFARGFLDHVQPEAIEAEPAAINTMYHGMCDLQAMKRIAPDEPFYLTVHDYHRSRSPNPRWTGRISQRGGGVCGLGKRPYSGCCTLFDSGNIHGFWLRIN

SEQ ID NO: 42140 - protein, 89 aa, A.fumigatus
RTRRSRSPFAFPPRHELVSHEFGLGAAPDLGRFPILGDFDAAHLVQVNSNPGVIPAKGVIGPFPPLFPQKGQFSLLGFFPTPLFDLPAP

SEQ ID NO: 42141 - protein, 96 aa, A.fumigatus
STGPVDQPASFITFVPKYDELLRNPPELTDIAVPGNMQWYVLTANAERMTTGYHVSAGEICFVQHAVFGCFGEPGSPHVATRIGGSSKELHFSTPA

SEQ ID NO: 42142 - protein, 154 aa, A.fumigatus
  UNSURE (54),(55),(56): Identity of amino acid sequences at the above locations are unknown.
IPIPGSSRPRVLLAHSPPCSPKKGSSPCWAFSPPPSLTSQPHNQGGGGGGEKFXXXHPPPPLPFFSSPSTQPNPLLFPSTPPQASLPFIPHPSSHFSPFPSTSHLPFISHFHIPLFDYHSPLRQLLLNIPTAVPRSISSLPPPLLPFSSTAIAA

SEQ ID NO: 42143 - protein, 66 aa, A.fumigatus
IVGTKVDQNHVNWVTAYNMLTGIRFTVSRINAKMDRELTPADFEAKHKFSFDMYDDRHLAFPLPRS

SEQ ID NO: 42144 - protein, 346 aa, A.fumigatus
QMANFCVAISTGNELTPSAKYDFKFKDYAPWVFRHLRAKFRLDPADYLMSLTSKYILSELGSPGKSGSFFYFSRDYKYIIKTIHHSEHKLLRKILPEYYKHVEQNPNTLISQFYGLHRVKMAYGRKIHFVVMNNLFPPHRDIHQTFDLKGSTIGRDLREQDLERNPRATLKDLNWLRRGRHLECGPSKRQFFLAQLERDVELLKKLKIMDYSLLVGIHDLGRGNEEKLRDKTLQVFQPGGDREEETSPNMLMRTPSKLENERKARELRMLIKKERPVPLDKAAAKMPEEILDERQYHVFYADDGGFRATHENGQPGDEIYYLGIIDCLTHVSALLRCNAASLPSRL

SEQ ID NO: 42145 - protein, 117 aa, A.fumigatus
QSPMRRATWIVFNLTLSNNFFSFYYSFPFPQYFLASQILLYIASLLASSALLRVTPYFKAAHRRTLAILCHPRRTWNLAACYFLLHFILAILSCPWIPVLDSIVCWEKPCFNFCEQI

SEQ ID NO: 42146 - protein, 172 aa, A.fumigatus
QYGTVKKLENFFKGLSHDRGQISPIPPESYGDRFVKFIKGITMSKEEVERHREARAQGEASAERTDSVERTMQAAEKEAAKDVSTTHPRTLSTIWDPADANGPGPTSTLPIVDEAGEQSSVGGHSQHSRQGPSLTEKDLPPLPGMGSSQDGPKGKGVSYSGPNGTLSPVASR

SEQ ID NO: 42147 - protein, 565 aa, A.fumigatus
TTRSSLPTNMDGSQAQANQPMVPPQQHSNLIRTDQVQKLPHLNEQQKAQHTQLVRNFWEILNSRDPQSAEYQNAHMRLTQLSQNLMKGMRMYQQNRQQALQQHQQAQAAAAAVQGQPVQRTQSANPQSFSQLLPQIQQKVNGLHFFLPPNISKEQVQTWLPEARLRYGIALQKQEIGRVRIAELRQQFAQRQSAGNMSQEEVQEFKNRQLAAEKLYREGSDFLNKFKEQQESFKAQQQNQQLNRAGLPNAAPGQPQQPQGTAEQAAAATGSAPAATPAPTAGDKRPVNVPGPMHPGQAPTPAPHTINSAVNAARNQAGQAAMPPSTTQPGQAPVTQAAGTAPAVPAAPSHQPQQQQPQPLSQQGTPGAQVTFSQTPNPDGSTPTPSASQPMTVQGPPRPLSHQAAMAQAAQNYTNNAANNNLAQQNVSQAAANPHAHPQGYISNRASENSARNINMAIPKNLNVPPPEPVSMAPARPTLSGGPSHGAMGMMGQPAIQKHPGYVLEGEGQRVLSKKMLDILVRQVTGGGEGEGLTPDAEEVSSILHIRAAFRCVRWSGYAFAKSSR

SEQ ID NO: 42148 - protein, 84 aa, A.fumigatus
FILQMADDFVDDVITAACRLAKLRPSSTLEIRDIQLVLERNYNMRISGFSTDDLRTVKKPQPTQGWTQKMSAVQAAKVTQGKAE

SEQ ID NO: 42149 - protein, 134 aa, A.fumigatus
PQGFYISLSVNNQRVFITIMATNGDFTDDESQPGSPMLDAANGQDDIEEQERLDVEEKPLKSAMKKGAAPPAPQPKRPELPEQPDPETLDLSTLTPLSPEIIARQATINIGTIGHVSHGKSTVVKAISECRLSG

SEQ ID NO: 42150 - protein, 205 aa, A.fumigatus
DSTPVCRVLPSPRSKVHQMRYVAVDPSVEAGEELLAVSTEDGRIIFYSTKRLQKASDDDESPIPHAEAVAELGGRAAGFPGRVKDFEILNVGGESTAQKGDLLVVTANSEGVVRVWMLRANSLLRNTKENPEASDNKSQGSKNLQVGKLLNVYETGNRITCLKAFVMLPPDPLTPDDFDESSGDDIEEDEEEEEEEESGEGSDEE

SEQ ID NO: 42151 - protein, 94 aa, A.fumigatus
TRCSVTSYSAPRTMRSRKYFIFFERFFPLYMISLYRIVAYFKIFFRRCLLSRKRKLSELYFATVGFAGATENAPTNALYHQKEQTFLDANDLTK

SEQ ID NO: 42152 - protein, 988 aa, A.fumigatus
YIYRGRYFNEATLPPFPDFAALIPRPEEQHSSEPVVQTDDVSSVIAPKAEGAVRGIAPSFQQQEGQTAQVIEQRLVEDSLKKDDARIHQQPALATTSEIPQVAKSPTTPAQPDQLPQKASFAVPDTPPTSTSHESVDASVSPALKELPPSEVAPPRAVSNQLPSAQRKPESRPSLVLAQPSEDQPLSPASSAGPYSNNTPAPVAVSPDTSPAEEVTERADEVALSPKRVGPVQLQPGLVPSTPDEQLQLEAAQSLQQNALASKSIGDVTTASSLSNEVIKEDVGPTPSAAADSLKETQDQTSTSVEAPEPKRPDGVVVTPEESQPPAQSIQEETQSQVGAEVKVVASTTPAGKKPTPAAVLPAQPERMTTRVSSGAIRHKSVSEILGETPKPSAVQPEKAHAIEKPADMVRAPASASPESTAKMRLKDRKAREKERSKLSTVVFPKQQQQQQQQQEKDDSLDIVRQYAGELARLNEEQDYLFTLFQNKAYAPPRGTNLSTLLASAHKTLTTSNHLLEYQEQMDCRTLRRIYALQNANRWPLRQLKRSVEPPRQGTHWDVLLDHMKWMRTDFREERKWKIAAAKSCADWCAEYVNSDPEHRALLRVPCRIPSKFEKKEAHASSMISPPEETTEEMLVVSQPTPDLIPSAEDESVSDGFNDEIRHDIRDTVAPAAIFSLGSDEFTFSLDMTPAAQKLLDELPIYTPVKIAPGANVPMFEQPPDSAWKTELLPVSKYASGRIKFHETESPRKRSRYDYLQYDSNPEHGMLDLPPEQTNVALFRPENKPIRDRIHPGHSFRPPTEYPMPSVGFFESRQSSQWTYAEDDELRRLVKEYSYNWSLISSCLTPSSQFTSGAERRTPWECFERWVGLEGLPADMSKTQYFRAYHQRIETAQRTVLAQQQAAQQQQQQQQQQQQGGNNSGQAQPPIRRRTTQPVRVDRRRSSKHLALLDAMRKLAKKRETMLQKQQHGKLSMSLRLLDYTKLYLYFF

SEQ ID NO: 42153 - protein, 384 aa, A.fumigatus
  UNSURE (262),(283): Identity of amino acid sequences at the above locations are unknown.
ANLAAQRAGQIPSQQPMMNAPPGRTPNGIPHNPGTPGIPGATPNGMHNGMPNALPNGIPPGMGVSQGRPHMQGVPAGGPPMNGPIPPNPMAMKMMPQTGMPQGPGGRPGMPMQTSPDNTRVMREANRLQEQQRILQSRQQQPQPPQHQQPQAQQAQQQFHNQQQFGPQGSHSPNMNLPNVNGTPNNPSYDGGYPSPGSGMQSPSFPLMPCFKACSLRSPRMGQPNLLSGGVVPTISSIQSQIQRSNPYMPPEQVNKLATDRXHQYQQQRMSQVAMNAAAGNMXSVQANYQVPHDGNFQSPQPGMNGTPGMQVPQSQGFSPMMRVPQPAQQNRMGVGNSPAMNVALPQQSRSATPQTQRSGSAQAGPVPGSSKSPHPPQAQIPSG

SEQ ID NO: 42154 - protein, 141 aa, A.fumigatus
LSDSHLHDAKAKAHHFKHKVGKFFNVVNPNHRHDEEHERETDKKRTAIAESHRYKSFAPVREGNRVKWYVDALDYLWAVSVALEEAKEVIYIEDWWLSPELFLRRPPYSTQEWRLDQVLKHRAEAGVKIYVIVYKEVRRPY

SEQ ID NO: 42155 - protein, 230 aa, A.fumigatus
YQKSQLGYHDSELAIVVEDQDFIDSMMDGKPYRASRLAATLRRQLWREHLGLLPAQDYDASKHPNAQPPNVCLNEILEGPENDFVTDPLNDDLWKTWTEQATTNTEVYRMLFRADPDDNIRTFEEYDNFRPQGGIKEGHLFDPYQPVKDVREKLDQIKGHLVWMPLDFLKDAEMAEPGLAVNQITEASLLLTRFGRYFFANLDAEHLYLIVCYLCPNSGVLRCNQDFDTI

SEQ ID NO: 42156 - protein, 63 aa, A.fumigatus
CSRRSTCLCATMQKSEVKLVTELNVDYSDIGDANKLFQNPFGIDENCGEVETESIVEVWSSRR

SEQ ID NO: 42157 - protein, 451 aa, A.fumigatus
  UNSURE (13): Identity of amino acid sequences at the above locations are unknown.
ARLPDVGRRPPLXYAPTDREEKPKHIVRRQVYELPGPNPDDENEKFDGPELSPLPVDAPRLLCILGDIDSDPTMYERAWEVSNNRYARAQRSLARHYLSLKPPALEKAEEAYRKSLHINRLNHSAWFALGCVQLELQKWEDAIDSFTRTVQLEDTDAEAWSNLAAAILRTAKPSETTEAAEEEHQDADADADSETKKAPQDPYKRKREALAALHRAAQLKHTDARIWDNVLTVAASIPPPATPFRDVVTAQRRVIELLGSKNGEKCVDIPVLSMLIDHVVDTYNYDDLLINVDENDENSERVVRSGTIAGQILSLVDDSVVPLITHSAPLWLLVARVEHFRGQPSKAFEAHEKAWRASVASCTQGAFQMGDEKKWMDVVRATERLVRDGYAKFGPMDKEGKHEGEAEMVAKDWRFKARSAVRGILGKGKDFWEGSEGWNRLKELQSEVGSS

SEQ ID NO: 42158 - protein, 216 aa, A.fumigatus
AHHEKFIVIDYAVAFIGGIDLCFGRWDAHQHPLADVHPANLKDEIFPGQDWNNNRIMDFQSVADWQSNEVSKADYGRMPWHDVAMGLVGDCVYDIAEHFVLRWNFVKRDKYKRDHGVDWLLLEGRTGDDEDLVGVQRPKYPCGQYIQHPLNPLDTKPRGMQGTVRGQIIRSSGDWSSGILTEQSIQNAYCEIIRNAQHLVYIENQFFSKFASVTML

SEQ ID NO: 42159 - protein, 165 aa, A.fumigatus
LTQLEHVFLFNLRAYDRINKTSALEELEKEAGVTYHDIQRGIAESIMSDSVHPVVGEEGDKHEVNYDDAEQEKEERLARLRRYEEKQEGRRSEQYRSKDSVAHTTMLNGGKMSEEPWEGDPESEKANFVQEELYVHGKVCIVDDRIAICGSANINDRVSIPSYNA

SEQ ID NO: 42160 - protein, 110 aa, A.fumigatus
STTAGYPLMISLVAGALPKKSVYHRQIKADMSTHASHTNPDAMNPNSTASTSVGPSPPQTQNGLSRSDCFFCASATTAFRLAQISCRNSLISSSVKAMIPWPWRLRVTLR

SEQ ID NO: 42161 - protein, 101 aa, A.fumigatus
RVQVTATGDQQKPIINTIGGAIVDACVRAGKEGRKFRVIIVMPAIPGFAGDLRQSAATGTRAIMDYQYKCILRGEHSIFGQISAQGVDPRGEFLTFTEAND

SEQ ID NO: 42162 - protein, 147 aa, A.fumigatus
THPLTLSSHLPIINTHNGHQIITHNYHLPRLSRNRLLRLVPLRHKTGGRPRFSNIPYRTEQGSIPKAPRGKVPYVSIQIGEQPPQTLADSTLITKALIEQGYVEDLNQRLSPTERMHDLALKALLEDKLYPYQVRVKSLRTTVTKLS

SEQ ID NO: 42163 - protein, 98 aa, A.fumigatus
ACTGDEVEMVTEGGEIAFVHRMIEESLHLRKRVVWYTSMLGKLSSVSAIVEKLMEYGNNNYAVTEFVQGSKTKRWAVAWSWTDLRPSMVCFSIPWSSV

SEQ ID NO: 42164 - protein, 79 aa, A.fumigatus
RNTAKVSSLLVPRAISFPPEVDTGSRRLSPDSNMSQSKAGRRRRSSSIIYQEPPESIEHTSDQAALPNLNANWVNAKGM

SEQ ID NO: 42165 - protein, 523 aa, A.fumigatus
QRAVPDTQALNLLLNILSPGAIASGPVYIPSPQYLAVAATFLVHPSTTSRAKTAEEEEAPSAALRLLRLTNTLVGPISARFAAAFAFNHFESSRQGRRRRVQDDENANGDISNDDARTLHIDLCHSASLWSRAEDFWHAVGWAFNCSVLHPERWARWQIWLQFMCEVLEDDWNERKRQSTGVADDEARREVLEKSLIFRYIAGGSTPYGRNRRILRAIFADGGSASVSEFRQVFHDELKTLKREDNNIKKREGEVNIDKDQFGDYLSEDEDGSEATDSAAPPPARRPTRQSKRIRRGAPPKDTPTADAVSADSPSTAQVHGGVSLLGGFPSLALRQRLLHLLSSVAEDLPASFTTLEELYHLFVENIRHLPLPIYQAFVSPFVLPHFSAAAQTTLCEFLLFRMRENAAPDTDEEYLNQAKLEECFLPYAANTPSIVDNAKMSIALESLLVLLAYSDMLTVTPELKAAVQDGIMARAEKVQVETRKSQSSRTTEDIEWCWLLESGDRLMFLVDEVLSRKGASTK

SEQ ID NO: 42166 - protein, 81 aa, A.fumigatus
SRYDYEHCPMTFLCALNNIIIDSLYIHVATQQATFSSRLIGLCSRLPSIVPSHLGPNESSEQLVVQVEKPSIAVAKILPCR

SEQ ID NO: 42167 - protein, 65 aa, A.fumigatus
YGAVLEYSKQFGDNGFEYHTEDYLGYSVASIPMCIAKGEPKITIQIDGHFLFCSKSTEQSRTHPI

SEQ ID NO: 42168 - protein, 167 aa, A.fumigatus
HKRASLTWRDAAWYRETADSSLSIAGAWTIHFVLIIALKIFYDIIPGVSQETSWTLTNISYMFGSFIMFHWVRGIPFEFNAGAYDNLNMWEQIDNGDQYTPTKKFLLCVPICLFLLSTHYTHYDLTYFTINFLATLGVVIPKLPFVCPLRLDRVVIANLVHSRTACG

SEQ ID NO: 42169 - protein, 83 aa, A.fumigatus
VSFPTYRMSRRSISFLTLPLGVSVFPFPVLLRAPIACYISLLDSTVYGIDFSLQFPNCAYNSLLICCMFVVCLGFGGNTIKNT

SEQ ID NO: 42170 - protein, 63 aa, A.fumigatus
VPPVQASSGISTGVRMRRFDYLGLSQHCLHIQASSTLYHSRPSIWLRVLLQVMAGAIKLDAGF

SEQ ID NO: 42171 - protein, 140 aa, A.fumigatus
KRSSARTTISRSAKAKSTSTRTSSATTYPRTRTGPKQQTPRRHPRPDVQPVNPNASDEAPPPKTPQPPTQSPPTHPAPPRCTAVSPSSAAFHPSPSANASCTSSPPSPRTSPPPSLLLRNSTTSSSKISATCPSPSTKRS

SEQ ID NO: 42172 - protein, 344 aa, A.fumigatus
GIMTGSSDNENDSRTASVGVQRSRLNDLADSSRPNSSDPNPNPRKRQRRNGKSAVPDVRDFVPQGATFTAASLEVDPDSASSSGSDSSDDDDSDSKSTTSDAEKQNTARTNPQAPAINWNKTSKSGIRTSLSRRADSTGENKQASFQFKAVNDKFWRSRSASVSSDGGDQDVTLVENEGDMEEGELDEETSAESSDMDQSGDSDDSVSLDSEADDSILLNIGDQNDQTDGLSAEVKPVSVNGLAASDRSTISKEESHRLFSQKYSVTPTILADLDRNDMEIQARCLFYDRDINDINLQLPVSCTECLKEGHLAAVCPSKEVCSRNIRLSVRYIPPMTHTVFWNL

SEQ ID NO: 42173 - protein, 166 aa, A.fumigatus
CVHCGAWNQHQSIFCPSWRRCQRCRERGHDEEQCTSLLQGSASEIPCDLCGSSSHLELQCDMMWKIPRQELPSGPVLVSISCSHCTSNRHLVGDCPSLSRPMVSSSFTLRGIDPHMVTNINSVISGRQGGPAPRRGQSGMQIRGRADRPSASSDSEDMMRLHAGFK

SEQ ID NO: 42174 - protein, 79 aa, A.fumigatus
FLGSLSVEILHERKVPSVSIRPGMASVTSLDKDLRNLRLSRYTPQAAAEVRTWIEETLQEKLPAGDLLDALKDGVALCK

SEQ ID NO: 42175 - protein, 571 aa, A.fumigatus
LDGHFRLINLAVSPGVKYKQSSMPFVQMENISHFLRACQIPPLSLPPHDVFLTVDLYESKDPAQVLQCLMAFSRRANALQPSKFPRAIGVQSKGGAVSPHLTGSSQSANTPLRSRGHSNVSNNSGASSPAKSPAVSSWSKKSDEQVTIPAWNIHQYGYMGGASQGNQGVAFGARRQITTPSPFVPSLEEKEKRRREEEERQRIEREEAERIRRQEREAEEERAKAEEERRWAEETARLKEVERRRLEEERRQWDEEQRKWEEEERKRQQEEQEAEERLNKARQRQREAGDVRLRGQFLSQYQAGLTGESRESQRIKELERELELAQERERQYQRERQELKEKETGQPQSQSPRPVPVPPKPSYSLSSLEQERRLLRTEWQKHQAHDGTAESEPSDAPPPMPPRPLPEPATPQSVAASPRPLPDPAAYANKSQGQESRVDRFLASNRPPVAPKPATHRPQDYTTTAEVDEENNRRVAAQQKTKAGGWASKSLLEREMERERERQREWEESQKQTREAAAKGLKDPTIGIGPGQGAWDVHQYGFMGGDNQNRGGPGLGVGGARRQIIGPRPPP

SEQ ID NO: 42176 - protein, 78 aa, A.fumigatus
HTRSSGIYKMRLLTTYSAYIVAPGTSTKAYSARPGGDVNDVENAVMMKNNAPRFSKAPHPRYLVISVDHLATWNSSAI

SEQ ID NO: 42177 - protein, 97 aa, A.fumigatus
ARTCQVHSPRSCPDQAASHPVWFACDSVKKMMLTFLLNSVGKQIVNVPSYMVRLDSQKHIDFALTSPYGGGRPGRVQRKKAAAAAGGDGEEAEEDEE

SEQ ID NO: 42178 - protein, 124 aa, A.fumigatus
GVACPAHPFQDPSCCSVCAFSDLRKLGAVTNIFRSSELLTLDEKDPKRLFEGNALIRRLVRIGVLDESRMKLDYVLALRVEDFLERRLQTCVYKLGLAKSIHHARVLIKQRHIRYGSHAIALKK

SEQ ID NO: 42179 - protein, 398 aa, A.fumigatus
  UNSURE (102): Identity of amino acid sequences at the above locations are unknown.
LRWRCTVNQRCVDVCRSPRRPTGAAPKPNTRFLRNIIKETDSHNAALKRKEEREARERMRQLRGQALSSSSNGTKERDRHRSRRLSDNLGSLRDTRGSRESXHHPHMRNRRSRSASSDRDGSRRHRRSHRSDDKDEKRHRSSREKHRRHSYSRSRSPRDDDASKSRDRYRRRRRTVSLSPSRSPSPDRHRGRKGRENTRHSTRRSSPNSHMAFEYATACGRGRTPSPRKESGFDSDPLEDLVGPLPPKHGVDSDWGAIRSRGRGAYKAKLSNIDAHFAPDYDPTLDVHMEDGDQDQQKGPSRRPVAGLTTEEDDWELALEALRDRARWKQKGAERLREAGFDDAVVDRWKSTSSKTTIGGDDEGRLEDVKWSKNGEGREWDRGKFVNDDGHIDVKASW

SEQ ID NO: 42180 - protein, 64 aa, A.fumigatus
HWRTALTQYREHNMIRFSNGSPQALWYSQHAGGQAFTYDATEKQGKRPYAYSAKGTHAVYVMVG

SEQ ID NO: 42181 - protein, 71 aa, A.fumigatus
ILNFGATSVVHLGAIAAFLSSPAIMPSNTGEMNDELSNDYVAEVLAKEARDSSMKYSAQGMGAYLPRRYDN

SEQ ID NO: 42182 - protein, 119 aa, A.fumigatus
SSSSDNDVAPLVWLHSQDPYMPSDIGQQLVHTTPMVDHKPIQGLQSPLTLDNLDGLNSLGNTSVYLTSREGISASPQPAWFKGTAPDQQGKTNGAVSSTIIIRDHNNGTVDAFYFYFYA

SEQ ID NO: 42183 - protein, 86 aa, A.fumigatus
FWCRLEQQKFLHTALGLKASCMDQAVMEIHFTTMDGILRIVVTVLDAVQILPNYALPLSNRNLDAADIEISSKVMGNTHRTTLFGL

SEQ ID NO: 42184 - protein, 79 aa, A.fumigatus
RMTNQNPAETLEQLRQLEQENGDLKTCLAIIRISEPISSSDAEKSNSSPSKRTSDVSAIDNPTPASLEADLTHYKVWIR

SEQ ID NO: 42185 - protein, 97 aa, A.fumigatus
GTWLIIDTPVSLGLSFNVLCLLGWVIAMSGLACQETTQSKKKQPRDMRSRGMALHLSRLFEEDYYYDLSWNPNPSLIRVFDFDSGVGWNNKSSFIRP

SEQ ID NO: 42186 - protein, 87 aa, A.fumigatus
SKAVTSPLVEEAALDGNQSGVPWKLSDKLLFTFPLSTSQHAVKGIRSEDNQDYQAKKSFNIPTQGFEHRTHTYRCHTYLILKRPPRE

SEQ ID NO: 42187 - protein, 66 aa, A.fumigatus
EHRLDEGILPGYEYSVFQATQDGTRTDFEKLDTEGGIATRARAVVLQAVRSTTMARDVRWDVLVCR

SEQ ID NO: 42188 - protein, 147 aa, A.fumigatus
DKEPTAPAEPNVSQSLQSSDPAKSEAKQETDEMTEILERLNLAADNNCVFSISDETQELLRKFTLIFKDLINGVPTAYHDLEMLLSNGNKQLQQTYSQLPGFLQKLVEKLPERWTETLAPEVLAAASERASRSGLNVENVGKSGCRC

SEQ ID NO: 42189 - protein, 435 aa, A.fumigatus
SAHNGYQTLSTPGPVKPKAQYNNNNIRLDEPLQLITNNSIVINAMTQTKSHKSPKGAIKDSRALNIMKHLDPKSSSSSSRRSSKSLPLSSFTTDHKRRASSSSISSVSSVSSIEALSDEANESEEDADDEKEQPAVRGPSYGRRDKGRKSGMKPTGRKRVRLSDDDGYDGQRSSDESDSDGSSDDVYAAVDDISDGDDEDQDVEILEELLIVESEDEHAVDDIFKTSTVSELDLAGTNSFEDHMLLSAASFFDEDQLYSAMETFGETDFASEAAAETPMPRRVHFEEDSDSSSESDSHTEDEIPSDFLQQDSLDPQLRRMIENDNENYSSRRRQSDELFAESDYGHSNIYHVESDAVSEESESSGYESMQCIWTFPLIFLLTCLKPMMARPQMKTFHHRQQLPTPVPFCAAIPLPLCLPPTRTKANPLLVGEVQS

SEQ ID NO: 42190 - protein, 96 aa, A.fumigatus
RPSVATTTDIKPSYGCPSTENSCLPILPLGLLASSAMPDMQTSARLLENARLADMPAARLSDESSWMPTGALKFLSKSSDATCSATTPYGRFERIG

SEQ ID NO: 42191 - protein, 343 aa, A.fumigatus
EYAVYLDFPLDLPTDLFEADDGETTDEDLPPPATITHPRSILRRDSSASLPPADENKSQPPTRRRGPILGTFVADPHKPVALVDCTGKHLVIIPAYASSRHDWLESATTSICGTANNSPRATTMHLIDESDTDALASPNRHDLSPMLASSANLMMTALGNDIAPGGQVMGPPEAFYPSRDFAIDSSFEDDDDDDPEASLNVEDFIDFGDGSSDEEMGKASDEDAIASPMATASMTVVSGTPTPNRGGDVQQSNSAERFLNHLDRGIVTAFRRNHNRYQALLRLPQHREFMPANSPSRPASVFRHARHADQRTPTRKRKASGYAGGEAVRRKLMDAHRRTQIPF

SEQ ID NO: 42192 - protein, 64 aa, A.fumigatus
SGSPSPLRPASTATWVSTSSPVSCRRSPASSPTPPPRLSFRPCSVPSTRPTAFWTSTRMAPSPP

SEQ ID NO: 42193 - protein, 66 aa, A.fumigatus
LPPLSASPRRYRVIALVVESLPHSYLGLSYIDYVRPFHHVAQVGVQICGLTDGRERVPEQVQRSPG

SEQ ID NO: 42194 - protein, 783 aa, A.fumigatus
KPRPALPSFGSIRGRREDEPEPAQPDFSDNESTASSGFDAVVSGWSVPNDHPAQGMSHPSVTNHPSGTEVDRIALTKSSEGSGDQTNIALRQDGDLVHELVSQASPALKPSVADANLMRGQEPFITPDVELALQGMAAQTTSPGAEKGRSSLEIYRVPGGFPRTSLELDPKAASKRKGKRRSRGKSIDEYMPNDKESGDESGESVYSDAEEGVDFDGFGSINAIVDARIAQGKDGRPVYFLLNNAFSKDDTRGFGAMSTNGAANKLEVSSQADCVTTPAQMQPAYSPSSAQAASTRSTVQAQTTAKDIHSSPRPTQAERPMSAIVYSDSGLRDAVAKDGSLHGLSGNGSSALHRADTERAKKRPVSFGPVIQKEIDLGPSSERLINGRTPYLPQRRMSNGSDSSSSFVRSTRRVKKGGQHTMRRTMRGGPPIRTLPPSPGRVSSPAIESRPLSSGSVTGTMRTTLRSGPKNDKTPSIFSNRSAKLKVTKTATPRFVSRFPDSDDEDADFRQRKLQRRYDNSSDDEQDRVMRGLRPVRGIPRRQGTNDGDSTELEDSSENERPATPAPAAVSKKPDLPSHDPGLAAVARSRGMTEAELDEFLHRPAKGRVSGILGRFTLKKSRPPMEHRASKSNPEDLAHMRDGNLLNPGRGATVTTVTANHSGTSPSKLTKGGLKKPNENSWPMDSGRKVSDAAADAETVAEQHPVATDASGDGSASIARHSEPFAEDSAINMQSSEAAPPREERHPGNSNGNNNVSAKDIVFPQGRRKKRFPRLRKAFGMRS

SEQ ID NO: 42195 - protein, 366 aa, A.fumigatus
YHLTFSPVPTPRYRESTSRYEPLPPKPVYDQALESQLDITEREYRRRTDPTYDVNLSYGRHQAPVDSYQAYQPQQTSDVSLHRSKTEIDVSYDKAYTPKPLETRKGDSFSRSELTVESVPSRPSSASSISQVKVLKPYTAIDQPPARKMGYYDDDGNYHSFRRGVERAVDRITHPFHHHHHHHDREEVVIADERGPVRYRDGVREDVRIVEPRASKTTAESVPIPCHFIRIGDILILQGRPCQVIRISVSPQTGQHRYLGVDLFTRQLQEESSFVSNPSPSVVVQTMLGPVYKTYRILDLHEDGTITAMTETGDVKQALPVVTQGQLFRKIRDAFSEGRGSVRALVINDGGRELVVDYKVIHGSRL

SEQ ID NO: 42196 - protein, 122 aa, A.fumigatus
  UNSURE (80),(90),(91): Identity of amino acid sequences at the above locations are unknown.
ILTHLNRNASTWNRVSTVWPSCLHSYRQYSSQYLPVAPVQSSPATSRDSSRDNSRRAKDSNSRQSESIANPKRRSTMNSXDAAYDEEEQXXRAIEESKEDTQPPAEDMALRRGKRSRSDSEA

SEQ ID NO: 42197 - protein, 78 aa, A.fumigatus
  UNSURE (3),(8),(9): Identity of amino acid sequences at the above locations are unknown.
NSXTGAAXXQPRGEDDKQATEYLELSYTSHLQADRISNESSWQWSSLLSKNSPSTWCWTGMMRRPEEKTSLMRGTYST

SEQ ID NO: 42198 - protein, 242 aa, A.fumigatus
DSSHCQNHCAPFASRCSTMTPRRSSRARTSQPSPAILQHTNSSSSSNSLARERSTRSNHKISSPQRSLTQRSQSIDDADSATRNDYPQTRQRQRSRGDDDHVRLNGEEEDEDEDGEGDEEEEITRCLCGQQDYPGLPPSRREALGRNGPTVGFKDQHALNLSTDSSDLMSDDIGSMFIQCDSCKVWQHGGCVGIMDEAMSPDEYFCEECRKDLHKIKNESNGYVSSNLFFTLISRISPSLIY

SEQ ID NO: 42199 - protein, 389 aa, A.fumigatus
  UNSURE (5),(6): Identity of amino acid sequences at the above locations are unknown.
RRGAXXASDRREQGGYSAPCRGHGSPTRQAESKRQRSVSLMTAQVTLVFCAAADPFSPPSHKQVTKRQRTSSPSPSAISKPENTESQPASEDELKTKVNGNGTKSSRVAPRGHREKPVKETEEPETDLSEIASRKRGKFERRNGEGKSPEVILGLLVLTHLQEADADREMASPTKATAEDPEPPQTSPETAAPAPEPAPSRPSTRKSGRPPARRGGRVGRNQYTRDRDTNGADSPRRGQSHDIGGDSPRVGAVNGAQYNVDSGKPSRPRYMNPQRTTMNEMKRRVAGILEFISRMQVEMAVAGETSTPPGNGDQPNGSLTKATMDQVETALVSNTNEVESGTSSVDSETASGQGPKEKEFKDLSSVEMMDVLTRHLLKWQQEYGKFGER

SEQ ID NO: 42200 - protein, 60 aa, A.fumigatus
ILLNASFLSLRPRISTVFNMPGGKGKSVGGKAGAKDAAGKTQKSHSAKAGLQVSISCVSQ

SEQ ID NO: 42201 - protein, 69 aa, A.fumigatus
LQDRDWYGTGDNVQTSTKYSVADYRRTWCHAMTVEWKTNSRGGYIVAGAGVQLGNTTDWSSLKIFRDRW

SEQ ID NO: 42202 - protein, 106 aa, A.fumigatus
LRLSRPLHIPHRVFCPDSLTCIILAAVYVTAVLEYLTAEVLELAGNAAKDLKVKRITPRHLQLAIRGDEELDTLIRATIAFGGVLPRINRALLLKVEQKKKNKSDA

SEQ ID NO: 42203 - protein, 219 aa, A.fumigatus
IDSLCYANSTMQTWLDQQPGMPSPFSNLGPGPLQSGAVRSETTVPSEGEDELIPTAIVIKNIPFAVKKEQLVQLMTELNLPLPYAFNYHFDNGVFRGLAFANFTSAEETATVIEVLNHFELQGRKLRVEYKKMLPLQERERIEREKRERRGQLEEQHRPMAASQLQTQSSMSSLTSHIPATSPSPVSQRGQKLGKSERANPHSQNSFKQFRCFPSVQLC

SEQ ID NO: 42204 - protein, 458 aa, A.fumigatus
TSRFLTRSTITLTMACSGVWPLPISPLLRKPPPLSRFLTTSNCKVESCGWSIRRCSLSRSASASSERSANVAVSWRNSTGPWLPRSFKLRVPCRLSRPTSLQRLLLPFRSVAKSWVSRSEPIHTPKTVLNSSDAFLRCNCANFTSIAEVDLNDSTTLSYYSQLLLFKEDPSRDSVLFPPTLTPIQRRTVHTLAHNMGLGHASRGTGEQRQVQVFKVAPGTNVSPPLTSIPTAVQPADTARRGLNRAATIDFSEARNEGGPGPFSNLRGQTSGFLGVLDSPGNYGSTQNLRAAKSFADLRSYTPSPVPSSASFPAALQSNGTRLQHYEAVTSGASNTPTLTSAPSGSSLGVQRDDNLLVNSLSSLSLGTGIGGPNSSPRRLRGMFSWDQPENQPSSAGPIGSNRSIGLGFDGQSQERMPIRQPRGPVPEKGSGFRRSNGHQSRGSDELRTNSGVEIIVE

SEQ ID NO: 42205 - protein, 111 aa, A.fumigatus
HITGYLLVLEYIAVFRLDSQLTQMPRCLSRIPAPYLLLGRLVFLFFIGFMTPDVRDPMFEMAAIFARGIITCFVFVIGHAMTRGAQVGYVLVDNAQGFIHNRAVLAFQLTV

SEQ ID NO: 42206 - protein, 650 aa, A.fumigatus
EKKDSSPRGNEKKPCLPFTMSPSTTKNRPHLPNNPHHQLEWSNSTANLFLGGVGVRKSWMLGASPSVSISSASGAPTIPLDSSCQSSLAVVSAPSSAFASAIANQPKSRPQGIQDPPSSSVTIVPRSQKSQKDNNEVAFTANGNFINAPTASPPSVLMSPVTPGGILPQNREILPPCPGVTPSLPVSTITATPNVSAPPVINESTVSVHATQPLQQSRSSSLSVSGFKAVPPIIALPVLETGNDRCLSHGVPPSPPPISGPMQIHRQLENPRQINQRNLMPATAAPTTVGGERMAEETSAPSTIRGGQRHQEIESPQQFIAPAPPEAQQQSRPSMTSAPPDWNHIPSSPVGLGPSTSFINQTFWTQSQEALDAFVARADSAMLLSETVELPRTRLLRDACNEKDLFYLTLHQIYTLRTFAPSEFARLPYVSGQNETGMEVVQQLLVDNHRLSGDFLRWSVNFPRPLGVMCQTREFPIVLHRIARSLGLFAEKWTAFDRHIRERGYPPLIDELVVQFGITSTVLLSIVFLALSRRIFGTQHEDQLRSIYSKNKRNYVERFGSRHTPQQIHRENEHLIQAYKALSRAQISPVGQQTSRVAQEHAAEPQRSLQPVGPTGQITYVGIPSPQMPVRASTRTLVLIADPANWLVPF

SEQ ID NO: 42207 - protein, 1005 aa, A.fumigatus
LTCGWSLDDFDARGTDELTLRRGEKIELIELDEGFGDGWYLGKDVRTGDNRSFPWWYAPLFRNKLVVVVITNKDRYLVYTTAAPKIPIRPPREDMIVSDDPKPAAEDQLSSELVASPKSGESTPQASRHASISETQPPEVATDLSSMKSSPNQQHRSSSSPLPTSRLAVDIQQSIRQTLDGQLKGQDSPVMNETLSVIDEHITDLSTPRHSVANHENKASNDSSSEYSSHLEHRVSYIRGHETDEEEENQPTEEQVRSWDAAETARHLRELGVEAKHCDIFEDQEITGDVLLDMDQEFLFMKEFDFGVMGRRLKTWHKVKAFQEEVKGLKQQQQQRGSASSYPAPPEDRSLSRASHTGPFLPRIPHLTRGSAGSIQHPRLVSSGISSTTSSPMTPQTPVFMDHQRRPSAASIREINHHRRHSSIDTGHRVDTSPHTGHFKQSSFDRNWTLASGSQRVPSRSGTYPIYPEGVLPQHTLRRPDTNESDSAVSVTDRYDELERGYFSGPEGDTTKNKRLLQKRSSVTGSATHSRQPSYADDKLKVNKRHSRISSVDSIRDTAKQAPAAVVDVQSTAAPKSRFRSLSTRVIDRRGPTSQSSTPTSTEKPSSGFFSSFAPLAPFVGKSDAEGSGRASSLSISQSKSAGPKTRRTGGLRIISDVVGKGIDTSVAPASPVRDTDPASVRTGSTTPSTSKSSERHSTESSIKNAEGGISLPRPNASVKAGPKSKKDTSAYMRGLEKKTPQEQMDGCDYSGWMKKRSSNLMTTWKPRLFVLRGRRLSYYYSENDTEERGLIDITAHRVLRADNDPIVALHATITGATASPTSPSPSNGADTSPADKSSTSPSARNSKLDPEGPFFFKLVPPKTSRTVQFTKPAVHYFQVDSVREGRLWMAALMKATIERDMSRPVETTNKQKTVSLKQARMMNQRPPALMTESELQETKEEEKRNRASTETEERNNGLRIHGLNVDKAPVTGESKEDEPASPDSLDGLDTGPSCLLPETLLKSD

SEQ ID NO: 42208 - protein, 78 aa, A.fumigatus
NINMINVLMLIYILFLYPLLSLTVPLWQYHYGNSPFNALSKVPAEGSRANTRYETNIHTPKEIDSCIKYVLYIDGVSG

SEQ ID NO: 42209 - protein, 494 aa, A.fumigatus
DQWKRKKQTKEQAREAKRAKLDPDSAKTAKDVMDENARKRKRGEEEEEEEEQNGSESSEEEELGSELPKEGLKRGDAKSKKQKQAATEQPDATAAKLEEAEARKKLREEKKAQKKAAQKEKKKAKEALKKDKKSEKSESKPASDKGEEQKPSKVENSDDEIEQEGAVPEEGLSLEFNPEPAEQSSSPSSTPNSPGFDASNDHSGSSSISSIAPPPASTDANDASQKSSSEPKPLKPTPEELKQRLQKRLDELRAARHADGFNGKPARNRQELIEARRQKAEQRKAHKKLLRQKAKEEEQRAKDEAMAKRFSPGGSGSLLASPRSPADSIGSNVNFSFGRVVFADGQVADPSLTNVREQPKRHGPQDPATALKAAEAKKARLAEMDEEKRADIEQKDMWLNAKKRAHGEKVRDDTSLLKKALKRKESAKKKSEREWKERLEAVKKGKDARQQKREENLRKRREEKGNKGKKPAAGKKKARPGFEGSFKAKVGGKK

SEQ ID NO: 42210 - protein, 174 aa, A.fumigatus
SILRSGFTSSGNLPLPPTLNTVTMFRSAVVRSLRASVPRAVRTPAAFQIRSSPVARPAQFAPRFAYQGVRLYSAPAGLNKEEVEGRIVNLLKNFDKVRSFNFFSLALSGPSDGTAKILPTMVFEYQITDAIDGVQVSDASKVRGHRLCQLMQWAGYPFHLQTFKKAMICHMDKV

SEQ ID NO: 42211 - protein, 182 aa, A.fumigatus
SFCLGETWNLMKIGYQLKQVRERLAKGLVDKGILRTEKRNFLLFDMATHPVADGGAKDDLHRRVRNVCTSRTVILPANQWLPEDAEFRYLRTVVMICAAYAANVLENALVTMSHEARERAFAQVDELLAEYSQWPFARRPGGGQAIGANLAQAINEEVNKAKDRELQLEVCFVVLYLQCYGN

SEQ ID NO: 42212 - protein, 69 aa, A.fumigatus
RVCQQEFSIEIPDKEADAIHSGKYTRTVPSESLIQVHLLILSTVDKAVEYILAQPDGKFISCEYKNPGY

SEQ ID NO: 42213 - protein, 146 aa, A.fumigatus
THHHIRLTAESPSSSVAQPVPRFQSTVLHPDILMASAGGLTRRRGGGRVAGGDDNDDSRVSSPISRNGSALDHRGPEASFTSSENGHKIAFDPRDLSESEERSKQPKLTLMEEVLLLGLKDKQVSAGLKILPRSSMSRLCALTRHC

SEQ ID NO: 42214 - protein, 93 aa, A.fumigatus
GYLSFWNENISSVLRGCIVIELVLRGRISMQKDSSRRRFPLADRVIEVIDDTLTGEVLLDEALKMMKSSEKMSVNSWIDLMSGACKHSWSLKF

SEQ ID NO: 42215 - protein, 394 aa, A.fumigatus
ILFIMKPAKPAQTDMDEQTFVPSTMRALYYSLSENHSHDVKAVDCPEPGLIFDTDFPTPIPSPTQYLIKVQTAAFSHDELRLAKVLNPRISMPNIPLHNFCGTVISTPGEDHWRHAGPKFKVEDAVFGLISHSRDGAAADYVLATENELAFKPRNISAAEAATIPLPALTAWQALFTYGKLNPADTGHVRGGLRVLVTNARNSEFGIQALQLLRASSLFPHYRPWICTTCDNEEQGTTLRDQFQVDEYIVAALPLPPDWDLATTFKQKQWEPVDIVIDCAGEDMFQQAHSPAVVKEDGAVLTAVDPTPAQNGRTEQDTQTSNGSKKKGPLSRFISVEPDGKALAHIATLVEEHSVRGRVESITDLVNSADILDADAAGAGGGRRGGMMVIRVNP

SEQ ID NO: 42216 - protein, 62 aa, A.fumigatus
ILKKQRIDVSVPNVNLEDHGRLKQHFFLTNVCWIVSASPVTDESRTKTHLILNLNNNWYGSN

SEQ ID NO: 42217 - protein, 131 aa, A.fumigatus
TLSTPQPGPRSPHSPRLLAVFSLLSDLLPYNCRNGLLDICCEAGRLPSPYSLPVGLFSPSFVLWVQSQPFSSSVSRAATPAGPPQPGFRLPAPRKWDQDPESSLDKASKYFLMAELFRGMYVVLEQFFRPP

SEQ ID NO: 42218 - protein, 157 aa, A.fumigatus
DRFSHYSYTIYYPFEKGPISPRFRGEHALRRYPTGEERCIACKLCEAICPAQAITIEAEEREDGSRRTTRYDIDMTKCIYCGYCQESCPVDAIVESKLIRQVDQYDPTADRIHAASNAEYATETREELLYNKEKLLANGDKWEPEIAAAARADAPYR

SEQ ID NO: 42219 - protein, 293 aa, A.fumigatus
  UNSURE (1),(2),(3): Identity of amino acid sequences at the above locations are unknown.
XXXMAALSSSPVVKTARRLRPFLYQTAPAHTVVIEIPLSDASIHLHQIGPTDSNGICSQTVNFGSRHLADGTRIRSYLRGWEGEVSMETLFAGPEGWLLISDIDDTIKYTMTSEPTGILRTTFVEPARPIQGMPQFYFHIQRQLVPTCFYLSASPYNLYPFLREFIYTWFTPGTLMLRESSWMDVGSLIRSFTTDTMEYKVNNMEKLYQSFPERRVLCIGDSTQTDPEAYAEIYRRHPTWVKAILIRKVTNVPHLEVKNSPERFKTAFKGVPESVWTVFEEPKEVYHVVDPLS

SEQ ID NO: 42220 - protein, 234 aa, A.fumigatus
VQSGGCRLRTDQSQPRRRRSRLRPRNGKRARIQAQEHQRRRGGDDPTTRPHRMASPLHLRQIEPRRHGPCSRWPARARHQRPQQRVRHPGASAAEGLVLVPALPPLDLHNLRQRRTGDNTPRPIPGRRVHCRGPPVAARLGPGHNVQAEAVGARGYRHRLRRRRHVPASPLTSSCQGRWRRPNRRRPHAGSERADRARYPDQQRLEEERPVEPVYLCRAGWEGARAHRHVSRGT

SEQ ID NO: 42221 - protein, 351 aa, A.fumigatus
DLRHRSNAAKTMPPKNPLSPPTKPFFKSQPVRHDGQQAPPPVVQYNLNQLSSTSTSAANGERILILTPMARFVPEYWDNVVKLTYPHELISIGFIIPKNKEGNAALAALEAAIAKTQSGPIDKRFASISILRQDFEPPLQSQDEKERHKISNQKARRESMSRARNSLLFTTLGPATAWVLWLDADIVETPPTLIQDLTAHDHPVLVPNCYQRYYNSEKKKMDVRPYDYNSWIDSSTAQSMAAEMGPDEILLEGYAEMPTYRTLMAHLADTANPNPKKVIELDGVGGTALMVKAEVHRDGAMFPAFPFYHLVETEGFAKMAKRLGYSVYGLPDYFVSRTFFFFFFFFFFFFG

SEQ ID NO: 42222 - protein, 204 aa, A.fumigatus
LEFRCDRDRKLTLTQNYRRLGLVHKLNAPTGGSEKKPTKDGRIEELPEDPLHIRSSAKASAKQAAMGETRVERDPETGKIIRVIRDEEEIEIAGRKVKPSNPLNDPLNELSEDEAARQPASQRTNAKSAVVQQLERQADQEGKAVKAKKPRHQSKREEEWIMRLIERHGENYSAMARDRKLNPMQQSEGDLKRRIRKWKANHSS

SEQ ID NO: 42223 - protein, 153 aa, A.fumigatus
DLPRRRLPGACALRHGRTQQESPPRTRDHGRLLHLRGHGQSSPHCNMMRKACPLTLAHRHRQLFPRHNHQLHHQHRQHRATEAQIHSRHQERTRRRERHQPQRQTRRLPQPHRRLHPQHHRRPGNVLLLLRLPHHRRNHNRCRLLPRNPPRSR

SEQ ID NO: 42224 - protein, 484 aa, A.fumigatus
  UNSURE (393),(408),(409): Identity of amino acid sequences at the above locations are unknown.
PRDCFHHCTRDDDMRYGISVHATEIFAHLILDFATPILLQQLLQAMQDMSSGKRPAMTYALATLVVRVVAAQSQVLNLWFGRRCYERSRGEMIMMVYEKALSRKNVFDTQSEQKDEGPANRELAEEDADEEAEIPTRRKFCGIFSGSRQTTKKPAKTAASMGKIFNLLRGDVYEVAQRFWEVDSLIDKPLGLIIAIVLVWKLFGPSCFLGILAIIVAQALNAVITRTLLRWERVRRLATDARLQITSQFVEALRHLRWYGWQDHWYRQVMDARQSELNLRIITNLWSILIRFVNTFASGVFPVVALYAYTLLAGHPLRIDIIFPALQLFTMLETRLRDIPGLITVLINASIAVERIEDFMAEPNKENPATKPADSASIQLQHCSYAWPGQVVXVLSDINLTISKGLTXXSGKVGAGKTALLQGAPRESWNGIGGSAKIPNELLGYCAQTPWAPEHEYPRRHPFSSSPYDEQRYQRVLDACGLAS

SEQ ID NO: 42225 - protein, 224 aa, A.fumigatus
CERHAHSHSHTDTDSSSHGTTTSSTTSTANTELRKRKSTPATKKEPEDEKDINPSVKLGGYLNLIADFTHNITDGLAMSSSFYASPTIGATTTVAVFFHEIPHEVGDFALLIQSGFSKRKAMGAQFVTAIGAFLGTFIGIAIQELGGGHSTAAGGVTGSSAGLLGTSLTWGDMLLPFTAGTFLYVGTVSVIPELLETGKDKAVEIKKTIVQFLAVAVGAGIMLA

SEQ ID NO: 42226 - protein, 756 aa, A.fumigatus
MHVALLPDLKNFEHGDLSFVGENGIGLSGGQKARVALARALYSTARVLFLDDPISALDHNTAEAVVEKCFTGPLMQDRLVVLVTHRTALVNHLADQKVLIEDGRATIHSKQAVSITSAADKDIQSLGKTAEAQSEIQGALREAAASVPTKFMEEEHRAEWGVKARVYWNYIRAGRYRWWISLVLVLAVYRLTSVGQSWFLKEWGEAYNQILLAFSNSTPDGRYSARQLVIPYGWSQVSRWKPTDPLEKLPAPFDDVRPWLLAFFVITAFQSVMLLFAQLLMLVIVYCAGKKLFHQVMVRVSHATFRFFDVTPVGRLMNRLTSDIGVVDGNISEQFQAIAFQAITWVSSIVVIASVTPAFLGFSFALTAAFIFIFLQFLPTSQSLRRLEMVSLSPLISNFGELLHGLTTVRAFHAEERFQNRVIAVVDKFQGMDHFYWSLQSWLMYRFETLSAASTLCLTVLALYTNVTPGLAAFVLIAANNFVTSTHALCKQFGQLQMDFVSVERIDELLRIEQENPGTIEPPACWPRFGQDITFDDVTIRYAPHLEPSLRSISLTIPGGSTTAVIGRTGSGKSTLAVSLLSVIRPESGRIIVDGIDIAQVDTQALRTRVTFVAQDPVLFPGSIRLNLDPTGEYSDEECADVLKRVCSRHGWNLQTHVEAGGRNLSQGERQLIGLTRAVLRHSPIVILDEATASIDHESSLEIQQVIREELRESTVITIAHRLEAIKDADYYVVLDKGRVSKHGYVNDKGTSQIQT

SEQ ID NO: 42227 - protein, 69 aa, A.fumigatus
TIEDIYLYNAALDEYLKGNPVRIFRIVTNVLISIRITDMMDTHLIQCFKGYPVLVAQVYLPSHIYENGK

SEQ ID NO: 42228 - protein, 601 aa, A.fumigatus
SSGWLRLRFTLWSSVVLAFIPLGKNEGQLGLVDSDARSLEYQITPRRVGASLFGAGIQSVSAIDHATIVLLQNHEVWVFSQYGYSRLSFPLGISSSFIRNSFMATRYDTSANRVVQVKSGGDTICARSSSGEVFTVRVNRSENPPTSTSTTNPSKTRNSLSAPVRVWTVKKSHMAATDVDVGQDGSIIICTASGSAWTKEKRSKAKDGTSKDYKFARVPGLSRVVGVCSNAYGAYAVAQRDYDVTKEQINVDQSTLWEDFLPLSPFASLVSTVTPLKTDDASDALSDGGSANAMKRVAMSISDIESYFQPLRNEAPEGTVFLLSSLSDARIPVHEFILTGRSSVLRKAFHEFRQAYYFSLPDILDIEYGPNGQCHVRFNGLDFLTILNLAFFLYADNVLDVWHQMRASAANTSRYRQVRSEVMRIATYLGLPTLERAARLMIKPMKSLKSDMAHAFNDPTFFESSDVTIELNGETMKAHSQVLCRRCPFFDTLFNGRSGGKWLLSRRTGANDSIRVDLKHLDRPVFEFVLRYIYTDAEEQLFDEVRSKTLDGFIDLVLDVAFIANELMIDRLAQVCQKMLGKFGMTFFKAFSLMASFTETL

SEQ ID NO: 42229 - protein, 608 aa, A.fumigatus
ASSKDGALEYICFNLEDVLAQRLVCILTHIRGDLNASRRCLRDLDENLVEALDTVCHENQMTSFPVSRGRNSEAYVLEKYPELVTSIQADRRRMIDSMRLQSRLNCLQSYEEKPRPVTDEKLRASLSVQKAKAASLKENSDIPRSPILKSRQSTSDLMFQMDDDPMLSPADSSKGKTAIRKGVASEPSRDFPALGTSLGDKQAFNNDSNVMPESLQSPQENALSDSPSVFRAAVLEQKKNGYPISSPSQTPWASSAISTPKKDLKDIMSETSEKRVSNLSLGMSARRENSNNFTPKLSQKERKKLQQQQLQEKLAAQEKAKEAPQNPWKLSTPVKLPDKPGTPFGSHGKDGESSQPSKFAQKPSMTLRQTVAGTPPPRSTPSATPTPGQGRSVSGGPQPPLKSSPQQAAAGPSTSPNGLASAQTPIKSIRHIPRPEPYQTSFCSPSPNSLSLAAILMQQQTEKDELREAATAKHNFQDIQLEQEFQEWWDKESRRVQGILEPDSTTASQKDSEGRGGRGGRGRGSNNRKKHGKGPENATGSPGLTQQLSRAKGQNGQKFSDSRRDNLQPETNGNHSSSAGGNSRRGGRGGHPKKGKERDRTVSGQTIQ

SEQ ID NO: 42230 - protein, 473 aa, A.fumigatus
HFGHMISTLWESFLRDDVESFQRCLANANYTSGSQRPSAAGGGSGFKVGSLDGVTPSSPFSSKGKKLSGTSPGATTPDRNTGSPRPGKALSRADLNTRDHYGRTLLHLISSSQKPSAIHFAKSLLKIPFLDLYAQDWESGWTALHRALYAGNATIAQALMARDISDVTDFSKSGNVGHPSGGLIKIKDREGFSPFEVYGATIASRDIKRITSSSASLIPLELEHSDIASDAPSLQDDSGEDSCVGRGSLNPRTNLAADEVFTFGSNKNLNLGLGDQDDRQFPVRINLERPEHLLHRFYREFLDRQSDDGEPSSQQDVTRTAELPALIKNKPIKIQAIAMSKLHTAIITDDPESNLFLCGFGPGGRLGTGDEQTRFGFVCIETGGLARKRVIAVALGQDHTLAITAHGEVFSWGSNKYGQLGYSLPRMQNRDDVPMQMSPRQIFNPFKKEVILGVAASAIHSVVFSSSGLYTSR

SEQ ID NO: 42231 - protein, 95 aa, A.fumigatus
IAVRHPHSVIANELLGILVDSRTITDLRRRDKHFDYYYTTGIYFKEEGKSSKVAGHNRKSPCYNHSNFDINNHNLSCVYEHTNYYFYQHANNNTP

SEQ ID NO: 42232 - protein, 94 aa, A.fumigatus
SWINRYRHNHVNEDFDLDTYKSRSDSYGYNACNGRFYPDHQSDSNDDGHQDRGLAWENRGRFKDDYPTWNDNSQLESCDAHGSRNNCDYYEDNH

SEQ ID NO: 42233 - protein, 523 aa, A.fumigatus
RDDDGSAGHSHNTAWSNDFDHCYAASKYHDRIRNYYYSTRVNYCTKRNSPWIAVSRDCISDCHPEYYYFRYSNVDWLVSRPTPCYTYWKFADEVGFDKAITTTEPAASTAQSGNTVTVPATTTTLFICPTLSINPTYTPVAPLPRNYTWGCPPGYLCKTKHTGADAGCNIEASMPAESYVCSPDECIKSSPFIHDQYWGTPVESSEIRSSYNISKDYFNLDPEIFGLNYSIFRIPDLKPGDDHYYIRSSRRTWSKLLARQSIGVSTVPGACYDECNDAALEVESTGKTPDICNAGSAFNVSLGQCEKCCNTHKTATSASFEQKVLPNFQQFLNFCEGLEDSATTAAADTVGSTTKGSQTSTTPGTTSTQERGTMSQADPLTASSTSNFTGKATKSRDKSSTAASATSVEQTIIPSPTQQTTAPHPMTESKPVTASGISTDTISSSSSCSATGTSSRETAQSSSACENTGNSAATSTSHRPTSTHSGASPSAPALLFTGAASLQTVPSHWGILAFIFGVVGFHI

SEQ ID NO: 42234 - protein, 564 aa, A.fumigatus
AATSLPTSATAYSAVAETSTSPAELRLDTPTVLLPTSSSAYWLIPGPSPILGAETSTSTTITPPAYTLRKRANPPKSPAIIARAPATITVTSTSTITTCPVCTNTPTTTSTNTPTITPPETTPTTSTITSTPVTTPTVGPGSTVTTTVTVTTTAPGPTETDTVTTTVGLPGTTETDTLTSTVTIPGTTGTDTVTTTIDLPGATVTATQSATSTITITATTTQSGTTCAATPGDGITQTTTVTVSSEGATTMTLTQTVTLPATTVSNAATLTEATSVAMSWFTLTVPGSTVTETTTSTKITTQTVTVSGSTVTGITTVTRTSTSTVTSPGSTVTGTTTLTKISTSTLTSLGVTVTDTMPVTEGSTQTISQILTMTATKTEVLPGRTVVDSKTITLPGTTIVNSKAVTLTVPGTTVTTMRTITKSGTTMTISEVVTLPGSIFTTIETIPTTLSGSIIVTTTTKPGQTITMSGSVTTLPGSTIIQSSTLPSVTTTDLQVIPTTLPGAMILTTVMRPASTMIVSGTITTLPGSTIVQSATLPGLRLVETVSVTVIQSTTIFDTVTLTG

SEQ ID NO: 42235 - protein, 60 aa, A.fumigatus
TNNNTLTNPADNRTAPNDGIEACNREWDQYGYYLQFIIMLSDRYLFERDCTKFFRMREHW

SEQ ID NO: 42236 - protein, 238 aa, A.fumigatus
YTALENCSLRMASLGSLTRSISTLVLQFNEYSSSVSSQPSEAAFLATVMPEYSQQHRIPLRVLVSPTNFLNLKRMYSQIPNVEVQAFRIQPRHLNISMMLLLMSVSQNDSMPLYMAQVTRVLREMAMESGGCFDYLDFRERLSALRLDRVQTPFLHQRLDLLDSYLDLTGQATSDYFVDGGVTILDLSCPFVDQNTACILFRIAIDLFLSAHPSRGKMIVADEAHKVPLWDRMGFVLC

SEQ ID NO: 42237 - protein, 195 aa, A.fumigatus
PVNVTVSKIVVLWMTVTDTVSTNRNPGRVALCTIVDPGRVVIVPDTIMVLAGRITVVKIIAPGSVVGMTCRSVVVTLGRVLLWIIVDPGNVVTDPDMVIVCPGLVVVVTMIDPERVVGIVSIVVNMEPGRVTTSEIVIVVPDLVIVLIVVTVVPGTVSVTAFELTIVVPGRVIVFESTTVLPGKTSVLVAVIVRI

SEQ ID NO: 42238 - protein, 243 aa, A.fumigatus
VAVTVAPGKSMVVVTVSVPVVPGIVTVLVRVSVSVVPGKPTVVVTVSVSVGPGAVVVTVTVVVTVDPGPTVGVVTGVLVIVDVVGVVSGGVIVGVLVEVVVGVFVHTGQVVIVDVEVTVIVAGALAIMAGDFGGFALFLKVYAGGVIVVEVLVSAPKIGDGPGINQYAEELVGNNTVGVSNRNSAGDVDVSATAEYAVALVGRLVAAYCILEVISSNRRLTDLPRFRNSDCFNHCLCYCHIFC

SEQ ID NO: 42239 - protein, 110 aa, A.fumigatus
  UNSURE (39),(40): Identity of amino acid sequences at the above locations are unknown.
SSEQKVLKENCYSAQRRLDEQIMKNRKLQTMLEESDFRXXTLNHDIAVGEVDLDEYGNQSIICELIFLLSGSLRKGFQSMEKRLKALSAKFFKSSTSTEPVCPIFTNGID

SEQ ID NO: 42240 - protein, 366 aa, A.fumigatus
  UNSURE (68): Identity of amino acid sequences at the above locations are unknown.
PKTVKGQLSLGRVSEFFEPESQSLDDRYRPRRGEATVLHHQSDESTPMCLISERCRDFDGLSFGTAQXQEEQERELAPEIEQERQIERPPPAEPKQHCLHADLLTFVSTGILKEHSSAVRPAFEALRNTSAARYLDVSQFPPGLRVTTDFATTIQFREGSSSLSDAYQRPVQWVLTHSIYDSTSGKRNASHVIIISPYEAMHLLSEVRRSTGATIHLYAPRQHLSFVPLDRLDLYNIPSRADPIDIPDDLKIQLNLFAGQLYIASYDEYLRLCDTLGVASAATPDNLSVAADGFILRGNVTGKSTFSQSPLKFLQVLLSQIRKDGQDISKTHIGKLLDGRLLEARNFDSAIEELTLARLSIRSHPE

SEQ ID NO: 42241 - protein, 233 aa, A.fumigatus
CHASTRNYAKSHPDLCILAVNTFVQDSEDPNPLIRALAIRTMGCIRVDKMVDYMEEPLRKTLRDESPYVRKTAAICVAKLFDLNPSLCLENGFLEMLQEMIGDPNPMVVANSVTALSEIHHAAPETRALQVTSNVLRKLLMALNECTEWGRVTILTTLAEYKTSDVTESEHICERVAPQFQHANPSVVLAAVKVVFLHMKNIKQELSSNYLKKMAPPLGISLEPTCHPESMAR

SEQ ID NO: 42242 - protein, 173 aa, A.fumigatus
QCWRYPGRVCGRVQRRILTGLVAALDLCMPRLIFFYQTQLQILTAVVKLFLKRPEKAQGLVQKVLQAATAENDNPDVRDRAYVYWRLLSNTSDPNATKNIVLSQKPPIVTTIHSLPPALLEQLIGELSTLASVYHKPPEQFVGQGRFGADAVQRAAIEFVALLLNPFLSSQLI

SEQ ID NO: 42243 - protein, 149 aa, A.fumigatus
WNREQIQNARENPLAAAAAAAAVTGATPPPQAQNNVENLLDIDFDGAAPASTQKEPASGMSGLEGLAGTPVRVESPAVGSPAPAASNNLDDLLGVFGDSGSTSASASTAIPNGGGAAADLMNGFSGLDLSANTGGNQQRKTNEDILSLF

SEQ ID NO: 42244 - protein, 299 aa, A.fumigatus
  UNSURE (296): Identity of amino acid sequences at the above locations are unknown.
LSFEDVVLKGLASDGGLFIPEEIPSLPAGWETEWRDLSFEDLAYRIMSLYISPSEIPSEDLQDIIRRSYATFRHPERTPLVELDGKRNLYLLELFHGPTFAFKDVALQFLGNLFEYFLVRKNEGKEGKDRHHLTVIGATSGDTGSAAIYGLRGKKDVSIFILFPTGRVSPIQQAQMTTVLDANVHNLTVEGSFDDCQDIVKALFADPDLNSTHNIAAVNSINWARILAQITYYFYSYFSLTKTSAFSKDTKMRFVVPSGNFGDILAGWFAKRMGLPAEKLVIATNENDILDRFFRXGGH

SEQ ID NO: 42245 - protein, 101 aa, A.fumigatus
TPIQVFSSFSRRMCLQTDDEGISVGGENMRIVDSILPCLSLSTSLDNFGYGPILANEEIIQLRPLWIRDDHLSQSMTSMFFFAFFWLIYPALKPDFTSSNY

SEQ ID NO: 42246 - protein, 144 aa, A.fumigatus
LPSTSTTIIMSVPFSQFPSTATIVPAPFQVAVPDEQIAELKTLVKLAKIAPPTLENQQQDRRYGVTSDWLTTMREKWLNDYDWRVTEARINSFPQFTTRIEDISLHFAALFSEKRDAVPVILLHGWPGKTLLPSIISSVLIEKP

SEQ ID NO: 42247 - protein, 60 aa, A.fumigatus
YSKPQSTPLNRLTRVGEKFLDWVDEPLPLETILDFVSLYWFTETYPRAIYFYREVWVPIS

SEQ ID NO: 42248 - protein, 221 aa, A.fumigatus
VFLLSPLVIPKAWHADIYIVTLVSSAPEVQYVALRNIDLLLQKQPDILNKELRVFFCKYNDPPYVKFQKLEIMVRIANDRNVDQLLAELREYALEVDMDFVRRAVRAIGQVAIKIESSCEKCVNTLLDLINTKVNYVVQEAIVVIKDIFRKYPGYEGIIPTLCKCIDELDEPNARAALIWIVGEYAEKISNAGDILAGFVEGFNEEFSQVWLLRSTCVCQG

SEQ ID NO: 42249 - protein, 72 aa, A.fumigatus
LEGMSIPQHPASAATIFLDQPPSCLQFCPSAPNNFIIGTYLLSENKDSDGNVQQTKTGSLQLWNLSPLSNEL

SEQ ID NO: 42250 - protein, 83 aa, A.fumigatus
AMNCEICTIFLPSSRLTDSLYKTLSSLIQRLALPYAVFDLHFHPRESSILAIANSAASVALFKFSTDPEPHISHLWTLTVNED

SEQ ID NO: 42251 - protein, 63 aa, A.fumigatus
WVESLDMFIETFRREVCIALDDINNYRAPGHYVSVLRIFIESDEASDNIGAETGQDHVVSSGW

SEQ ID NO: 42252 - protein, 82 aa, A.fumigatus
VDDSRVETESKERQGNRRGNGVSWIHGGCQFPCHSSIHSCDWTIDCQPYHTNMALDKHGTSGMCKWYDEIPTFNQLIGPHIR

SEQ ID NO: 42253 - protein, 199 aa, A.fumigatus
SIVLSMFSRRKYIYIYICASPQRANRDIQQVAAGRILHALNADAKVTVVCPHSGLNDEVAFRVSEGQVTHVDRTFEPEDLEGADMVLCAIDDPDASSRVWKLCKEKRIPANIADVPAECDFYFGSMYRDGPLQVMVSTNGNGPKLASIIRKKIAASLPDNMGAAIENVGKLRKKLRDVAARPEEGPSRMKWYREPYLSG

SEQ ID NO: 42254 - protein, 426 aa, A.fumigatus
RGPSSPVVKTAGQVFATVGRDIQGEKYAQASEEMANKTEQLYRSLIRAQRKTAVREALSRFIPATSVRHVGSMFNVTWMSFLSGLSAPMQDTQNLETIKLCMEGMKLAIRISCAFDLETPRVAFVTGLAKFTNLGNVREMVPKNVEALKALLDVALTEGNNLKSSWREVLTCVSQLDRLQLLTDGVDEGSLPDPSRARIVPQTPSDGSRKSMQASRRPPRPRSVNGPTAFRSEVAMESRSAEMIRGVDRIFTNTANLTHEAIIDFVRALSEVSWQEIQSSGQTESPRTYSLQKLVEISYYNMTRVRIEWSKIWDVLGQHFNQVGCHTNTTVVFFALDSLRQLSMRFLEIEELPGFKFQKDFLKPFEHVMANSNAVTVKDMILRCLIQMIQARGDNIRSGWKTMFGVFTVAAREPYGKQVFYRLGSM

SEQ ID NO: 42255 - protein, 126 aa, A.fumigatus
YLEEGIVNMALEHVTQIYNTRFGVVITQGAFPDLIVCLTEFSKNMRFQKKSLQAIETLKSTVTKMLRTPECPLSHRGITSEGVQEDGTNLAKQLSRQSQEEQFWYPILIAFQDVLMTGDDLEVRSR

SEQ ID NO: 42256 - protein, 94 aa, A.fumigatus
VTMRGVQIFSGTSHPVLAETICERLGTLPARAVLGKFANGETRVDIGVSVRNQDVYIVQSGSQKINDSVMELLIMISACKGGSAKSITGELFVE

SEQ ID NO: 42257 - protein, 364 aa, A.fumigatus
FGPGNLANSETRALTYLFDTLIRHGGDFPQEFWDVLWRQLLYPIFVVLHSKSEMSKVPNHEELSVWLSTTMIQALRNMITLFTHYFDALEYMLGRILELLTLCICQENDTIARIGSNCLQQLILQNVAKFQQEHWTKVVGAFVELFSRTTAYELFTAAASISSKPASIRNENGEASNEDGLHKTEQETAESTRVQETPSDAPKVNGSQPVTSEHEEGDMPAASTPELEDYRPQAEPQQQPAAVTVARRRFFNRIITNCVLQLLMIETVHELFSNDKVYAEIPSHELLRLMELLKKSYQFAKKFNEDKELRMQLWRQGFMKQPPNLLKQESGSAATYVHILFRMYHDEREERKSSRGETEAALIP

SEQ ID NO: 42258 - protein, 127 aa, A.fumigatus
VLRALSLPTTANNMILSSLCADIIRSFVRLDEDSQHRNIVAWRPVVVDVIEGYTNFPSEGFDKHIETFYPLAVDLLGRDLNPEIRLALQSLFRRIGEARLGIAAVQTPISPRSSISQHHSRRYSRDH

SEQ ID NO: 42259 - protein, 368 aa, A.fumigatus
QMVGTMTNRHLTEYQASQMQGFFGKPVDNLFAEPFIARWIRMNVPGWKEAVVVSKNAGGTKRVTSLADTLKLNFGIVTTDRRRPKVAMSMTDSTVFFDSMNDSIPKDPKPFVLHLRKNSQGGESSERNTAETEELLRPVTPPAARRPSELEAAHEYTDVRVRDVITGRLVQGHIVDDDFPSGGPTSVPASGHTTPGQPSSQDQPESVPDAMVNSFISTTSSLPGDHALGGSFDAAESSDEEESNGRSVEQEKMITLVGDVRDRTVFLVDDMIDKSGSWIAAAETVVKRGGAKQVYCIATHGLFGGDSLEQMEACDAIDYIVVTNTFPITPQMMRKSKKLVIIDISSLLAESIRRHHYGERSVVLRTDL

SEQ ID NO: 42260 - protein, 649 aa, A.fumigatus
LSSRELWREEAKLDSILANASNEVDRAERTLSQMMDHNTSRGIAAVRRIKRQHNLEGVYGTLAELFEVNDRYRTAVEVTAGQSLFHYVVDTDETATKVLEILQQEKAGRVTFMPLNRLRSKPANLPRASDTIPMIDKLQYDSAFEKAFNHVFGKTIICPNLQVASQYARSHGVNAITPEGDRSDKRGALTGGFHDSRQSRLDAVKNLTKWRDEYENKKNRGAEIRKELEKLDQVITKSVGELQKLEQQRHQVQHSSGPLRQELRSKRDLLQKKNDSLDAKRKALRNIETNLAALSDQVNAFEAELNTPFQKALSNEEEAQLESLSVVAQNLRQQYQELSAQRSELEARKSILEVELRENLNPRLDQLVSRDTDMGDDDGQGNLKETEREMKRLRKSLENLSQRLQNVDESIEKANAQANELEKQKAEIRLELEELARSIEKHQRRMEKNMQKKAALTKQAAECAANIRDLGVLPDEAFTKYKHTDSNTVVKKLHKVNEALKKYSHVNKKAFEQYNSFTKQRETLTSRREELEASQKSIEELISVLDQRKDEAIERTFKQVSREFANIFEKLVPAGRGRLIIQRKTDRALRQEDDMDSDDERAQQSVENYVGVGISVSFNSKHDEQQRIQQLSGGQKSKSFLSRAHRLTY

SEQ ID NO: 42261 - protein, 98 aa, A.fumigatus
TGLCALALVFAIQACDPAPFYLFDEIDANLDAQYRTAVAQMLQSISESTNGQFICTTFRPEMLHVAEKCYGVSFRQKASTIDVVSREEALKFVEEQKT

SEQ ID NO: 42262 - protein, 113 aa, A.fumigatus
ILASRASKMYVKQIIIQGFKRYALSSEQTLKKLSVAAKSLIASSYKDQTVIEPFSPKHNVIVGRNGSGKSNFFAAIRFVLSDAYTHLGREERQALLHVCGALSPSNVSLAHIH

SEQ ID NO: 42263 - protein, 404 aa, A.fumigatus
EGSGSAVMSAYVEIIFDNSDDRFPTGKPEVVLRRTIGLKKDEYTLDRKNATKSDVMNLLESAGFSRSNPYYIVPQGRVTALTNMKDSERLNLLKEVAGTQVYEARRAESLKIMHETNNKKAKIDELLDFINERLAELEEEKDELRNFQEKDKERRCLEYTIYSREQQEISGILDNLEEQRQTGVEDTDLNRDRFIEGEKGMAQIDAEIAECKQQIEFLKVDKVQLEDERREASKALAQVELRAKSLSENQATAQVLKARYDEDLRTVERAIKEREAELEELIPRFNAVREQEDNIKAQLNEAETIRQRLYAKQGRNSRFRNKSERDKWLQAEIRENHTSISTVQAVMAQTQEDIKELENDIALLEPETERLRQQIDGKGDTVHSVEQQVQAAKDERDRLMDQRK

SEQ ID NO: 42264 - protein, 78 aa, A.fumigatus
GDISYRQLHPSKDKIKQSPDCRAISVVDLSFSLPLPPTAPLQISLFLSFSIFNIFTNRRIVRDEVFTAGLEGAVQVKR

SEQ ID NO: 42265 - protein, 85 aa, A.fumigatus
AISRLKLPVLNNISGIKSCLSQETISLEGIMDTTSEPPAFNLTDTDREVLAMTDDQFVPHDWDNLKDIIGMRSRPYLVRDRLINK

SEQ ID NO: 42266 - protein, 198 aa, A.fumigatus
FAFSPHTARNDLGALKRKPSDLVRYLSWSRDTKAQYGSITNFICKRRLGWHLPEPAGTDDSSGTAVADSEPVFPYNNPIPFADPSDYKILRNDWPYGLAPGIAHLCVWLRTPVPVQEHGGDLTDESRRLIEEFVRRTFVERLAREGYNNPKDHVLWFKNWTALQSVRSLEHIHVLIRDVPESILFEWTQEPPRDGLPN

SEQ ID NO: 42267 - protein, 570 aa, A.fumigatus
DILAVMSTQTPSTQAASLADGLSPSHTYVPNRGYVNAEGTIPAMAGQDPEVQEVEEDEDEYYDDIFEEELDEEDFTSSNTADLTKAYNRQRKVNELAADPNAPKWTYPKTNTQKPTVNTYASVDDQVKSLTRHAAKIKLDHVQSGLAVRGERGGDRADRATSEQVLDPRTRMILLQMINRNIVAEIHGCLSTGKEANVYHAIWFPDEEEIQHHRAIKVYKTSILVFKDRDKYVTGEFRFRQGYSKSNNRAMVKLWAEKEMRNLRRIYTAGIPCPEPIHLRLHVLVMGFVGNSKGLPAPRLKDVEFDIPEPETRWRELYIELLGYMRVMYQTCHLVHADLSEYNILYHKNKLYIIDVSQSVEHDHPRSLEFLRMDIKNVSDFFRRKGVETLSERTVFEFIISTDGPATIEASEEMRGAIEKLYTLKPDQAETEQDTAVFRQQFIPQTLEQVYDFERDAEKVQAGEGSDLVYRDLLAGAKSSSKNIPDGEDDQGSDASGGVSVADSASDLEEVPHGEDPFAKKQPRGKRFEDKDSKREHKQRVKEEKRQQRANKMPKHLKKRLVSTSSRKKK

SEQ ID NO: 42268 - protein, 281 aa, A.fumigatus
ALETMWHRDVASINYIETSTWTRQEHNGFSHQNPSFIGAVLKLKPSAARVYLPPDANTFLTTLHHCLKSKNYINLMVGSKQPTPVYLTPEEAESHCRAGASIWRFCSTDNGLDPDVVLVGIGVEVMFEVITAAAILRKRCPELRVRVINVTDLMILENEGAHPHALTTEAFDNLFTYDKPIHFNYHGYATELQGLLSGRPRLDRVTINGYMEEGSTTTPFDMMLVNKTSRFHVAQAALRGAARRNESVRIRQQELYTELNHNIAETKKYIIENRKGKFACA

SEQ ID NO: 42269 - protein, 77 aa, A.fumigatus
RKIFTMPGEVIDTPNPQALPSHIPDVVEQLQVKLDLTSLEQPACDALIKFRRAASYIAAGKLATYTSSAVLANVSQR

SEQ ID NO: 42270 - protein, 90 aa, A.fumigatus
RDPTHALTLFPGHWGTCPGLILVYSHLNYLIKTRDLDMLYVVGPGHGAPAILASLWLEGSLEKFYPDYSRNAEGLRNLISTFSTTAGLPR

SEQ ID NO: 42271 - protein, 221 aa, A.fumigatus
GWTGPKKLHGKFIEGSFHSHQVPLPKAKKDKEELQALHEWLSSYGPNELFKENGDIIDEIKSIIPSEDSKKLGQRVEAYKAYAPPNLPDWRHFAIDKGSQGKCNESNREAHRRRFSRLIFTEWDFSSPDELESNKLSAALDRTGRNFQWDQFSNARGGRVIEVLSEHMCQGFLQGYTLTGRTGIFPSYESFLGIIHTMMVQYAKFIKMVLRSLVAQSKMGC

SEQ ID NO: 42272 - protein, 201 aa, A.fumigatus
QGIAPTFFTAGIYVLLGRFITILGRESSIISPNLYLWIFVTCDIISLVVQAIGGGMASAATNDVNGDTAPGTHIMVAGIVFQMASITVFVILAADFVRRALHRRLLQSMSGSIVPLFGAMIFSVVCIYVRSIYRTIELSEGWSGYLITTERYFIALDGAMMVAAVVVFNVFHPGWMMPTGKSMQFQREIYSADGLPATELR

SEQ ID NO: 42273 - protein, 197 aa, A.fumigatus
LLYGPGADNVRRSWHAIKYIDPAESGAVLPILHLNGFKISERTIFGCMDDRELISLFTGYGYQVRIVQDLNDIDTDLHRSMTWAVDEIHKIQQAARSGKPILKPRWPLLILRTPKVCPLRKDYQRESVWLTLAPITDRDGRDPRNCTASSSRGHSIRTRFRFPKRRRTRRNCRPSMSGCRRTVPMSFSRKTEILSTR

SEQ ID NO: 42274 - protein, 215 aa, A.fumigatus
  UNSURE (149): Identity of amino acid sequences at the above locations are unknown.
SFVSASLHAFQSIITHRCQSCVPLHQRSWKSKPREHKRDAYQQGGSFLSQPSRTKLMLIAIQAEEILNKQSGWKALTGTTDFSRIAVENPPSHAHKLAFDIVVDRILGFVGNYFVKLDGQVDAIVFAGGIGEKSALLRKVLVEKASCLXVAVDTAANETGPAEDQTVLDISKEAGKRPRVLVCQTDEQVSRRPLTSCLNELLTHLISLRWHIIAF

SEQ ID NO: 42275 - protein, 70 aa, A.fumigatus
RANTSSSRPDLMSESDGIDTSPEKIIQVVLLFDHAPWYLRSAMYDETRIGTGPVTLIGLRPRGLRRSISP

SEQ ID NO: 42276 - protein, 139 aa, A.fumigatus
HLPPARRARESSSFVRVIFEGIGKEWLMTLITIRHNYSALEIIRTCKQEIPNVKSVTFFDSAFHQTMPEHVKTYPIDQGIAKANGLRKYGFHGISYSFILRSVAEFLKKPVEETNIIAMHLGSGASMCAIRNGKSVDTT

SEQ ID NO: 42277 - protein, 90 aa, A.fumigatus
TARIGRQHIVLGTQADNRITISNCYIDGVTDYSATCNGYHYWGIYLNGSNDMVTMKGNYIYHTTGRSPKVQGNTLLHAVRSFPSSLITPN

SEQ ID NO: 42278 - protein, 121 aa, A.fumigatus
SPLTNRGNQVNNYWYDNAGHAFEIGSGAYVVAEGNVFQNVKAVAESPISGKLFSSPDASTNKVCSSYLGHTCQINGFGSSGAFSQADTDILSKFKGKNIASAAAYNTVVSSVTANAGNGKL

SEQ ID NO: 42279 - protein, 83 aa, A.fumigatus
FGRLLSRAVTPTLFLLLLLLLLFPYLFLLLFLLLPLLPLFRLFLLLVNQPWLAFLDELLRRVQHISPMLRMHIRPPQMKVLQR

SEQ ID NO: 42280 - protein, 103 aa, A.fumigatus
SAQPHQMGVESIDTNYTADTTRDHFKSGTTFRSYDDDAFSYTDTVELSVAVANPESREWRPRVKDWLVLICISTLTMLVAFDATMVVPFIPVRHPSQPSEPPS

SEQ ID NO: 42281 - protein, 318 aa, A.fumigatus
CIECLLGSVTQKTQEFIKHDAEEKAKEKAKSTKEESAVALKRHKFVLYPFKPRLSKAHLDRRWTAVKFLCKRPLSEDTKCYTFELPSRDKKLGLETGQHLQIGFHFQDRLVIRPYTPTRPILESEEDGTFDLVVKTYFPSSAQPGGTMSNILDCLQEGEEVEVKGPAGEIRYRGNGEFRVDDKTYHFDHITLILGGSGITPGYQLIARILRTEQGKGPKVRAIDANKSEEDILMRGELDKYATENADQFQITYVLSHPAEDWTGEKGHVNEKILHKYAFEPGEKSVALLCGPPAMIQKAVLPVLKKWGYDEDKNLFGF

SEQ ID NO: 42282 - protein, 540 aa, A.fumigatus
DFHLRRPDVHPKHWRYVLHTTEEFIKEGQPWLINEKKKETEEGEKGKKKKEQQEKVGEQQQQQKEQEEGGSDGSGKKPAESGQEGPDQGDEEDSKKPKYTPEQQALLAYLKQEAEYMQSLKSNDGKGRSPARSSSVPGEIDEADQFTPDNWVPRTDHLIRLTGKHPLNGEPDLVELFDAGLITPNYLHYVRSHGLVPHLLWENHKLEISAGKSLTLLMDDLKDRFESINIPAVMACDGNRRKELNLIKRSKGFNWGPAAVGCAYWKGVLMRDVLLMADILQLMDEYKDVPLWVNFGGAEILSEGKYETSIPLDYCMDPCNDVILAYEMNDSPIPPDHGYPLRLVIPGYVGGRCVKWLEKIWVTDRENDTYYHIFDNRVVPSFVTDRFDEIGQTMYRLPSTACNEQMLNSVIARPAQGERIDLAEVRKGRKYRIMGYAYNGGGNEVQRVEVSLDGGVNWLYCVRKVCREPCLRPVVMLFDASDTEQFPEAPLRHGKKFWTWLHWHVDIDITQLLRAEQITVRCWDVNKNTQPENPTWNLEG

SEQ ID NO: 42283 - protein, 145 aa, A.fumigatus
SASWDPSPRRRKSSSSTTPKKKRRRKQNQQKRRARLPLSVTSSFSILSSHVYQKLTSIADGPRSNSSANDHYRKTRSATPLSSHLETRSSAWKQASIFRSASTSRTGLSFAHTPLPGPSWSPKKTAHSTLSSKRTSPVLHNQAAQ

SEQ ID NO: 42284 - protein, 266 aa, A.fumigatus
TPFLTNCQSLSLTFGEPLSSNLWLNSCYLLASATGQIFFSMLAEVIGPGPLLVAAAVLSTVGTGVCSGSLQLSELVAGRFIQGLGGGGVVSVSLLCLAENIPDKHLIRFSNYVSRVRLAGAILGLVMGSLLFEYIAWRGAFYSSFFFCALGMLVIPFAIDLRGHRGISSQTFLRLDWLGGVLTLLGLCSLLIGISWGGTSYAWSAWQVLTPITIGASSMLVLAVNETNWAVRPFFHRNDFRTLPVLMMYAGSFLHGFTVKSPTSPN

SEQ ID NO: 42285 - protein, 216 aa, A.fumigatus
TRTPSRKIRRGISKGECRAMKANRRCTSLNTSSMMNNCHYVVKSETFVEPTNNKPYLLFRHPAEAGTGDNGWMKPSIDIQKEDIRRSAAVPEKQFTREEIEKHTTDDDCWIIINDKVYDATSVLSWHPGGKAPIMAHAGRVHQDTSKEFESIHDDYAVRKLEGIPSLFAPIGRANIVHRVPPGIRHPEDARVHQARRRRKSEGESKINKRGERGCP

SEQ ID NO: 42286 - protein, 193 aa, A.fumigatus
RHAGISSHSQTVEHEEPAELRKSLFDDPASQPEEWENVFRTNVTQLFFTTTAFLPLLAKGSEQEHGWSSTVINISSISGIVKISQHHFAYNASKAAAIHLSKMLAHEISSSKLKIRVNNIAPGVFPSEMTAGESDEKQKSFIPREKYEQKVPAGRPGKDEDMASAVLFTATNQYLNGQTIVVDGGYVLAAGTV

SEQ ID NO: 42287 - protein, 146 aa, A.fumigatus
DRADHCGLPPCRHPLLHGDRRFWPDGGCHCPGRGHLHWYRGARHGRRPAAIHQRRRKREAISPLSTQSPHQRPKHFLPQRRAVGRGLPIRRDRLRPNLARTKIPHRRGVQGAQQRRRGDRRRRQRRSRTAHCGCRHRRRLRQRRRH

SEQ ID NO: 42288 - protein, 1126 aa, A.fumigatus
TAGPSVQSHTLLNTLEIAALGMAQSPASSEPLKQDFKLGVDNPNEPPDGRTGRATRIQFDGDVPPEEGSGGIYHSRLSRHRSLSRDTIRSSHDASQSNKAAGIPIEFRTLSFQISESQNATEAAIKARQGKDNKPDQDYFESLDYHILQPDRLFQQLNVDPRSGLSSSAATSRLQRDGKNVIAHHSENYLKKIFFYVFGGFCSVLWIGVIIFFICWKPLSNPPSVPSLAMAILVLIVIFLQASFSAFQDWSTKHVMNSILNLLPSEALVVRDGKQIRVPSTDLVAGDIVHVSIGNNIPADMRLFQTSGDVRFDRSILTGESDEIEGAIDVTDDNFLETRNIAFMGTSVTNGNAVGVVVLTGSRSVMGRIAKMTTGVKEKPTLIQKEITRFVTIIICLTVTLVLIILFTWVGWLRVEHYQFMNVVSMLNNVMGCVVAFIPEGMPVGVALTLMMIATRMKKNNILPKGLATVETLGCVNVICSDKTGTLTQNKMFVRSLGLTDQELHIEKLLGDQGGSAERPEALSILLRGSFLCNDASFDPATVGLPVNDREVTGNATDAAVLRFVELAQPNGLSQYAQYERVHQIPFNSKNKWMLTMHKDPQRNSSYLTYVKGAPDVLLPRCTSYYSGLESRIKPMDENARRMLSDFQTSLSRRAERVIVLCQRYYTPSAAVGSNDFNDEVLAHGVHDLTVIGIFGIVDLPRPETARTIAACRRAGIRFFMVTGDFGLTAAAIARDVGIFTGTAEPDTVDDLRLSTSDDENEKQSLRSRRSLLINGPSISSLSDEQWDAVCQYEEIVFARTSPEQKYRIVEEFKARNNVVAVTGDGVNDAPALRTADVGIAVVSGSDVAIEAADLVLLDKFDSIVDAIRLGRLVFQNLQKVIAYLLPAGSWSEIWPVLMNVFFGVPLPLSSFLMIIICVFTDLFLSLSLIMEKEEFDLLSLPPRNHKKDHLINLKIYAQSYLFIGVMETFIAHSMFFLYMYKKAGIPFHAVIFAFESYSDGFYGYSAEQLAHFNNVGQGVYFVTLVMLQWGNILSVRNKRLSILTADPVRKQRRNPWLPLAMLVSLVIAIFVTEVPGFHTLFGTAPVPIEFWFIPLPLALGILFMDELRKLLVRAFPRGIIAKISW

SEQ ID NO: 42289 - protein, 93 aa, A.fumigatus
RRLPLPGTWASSLVPRSQTRSTTCGYPPATTKTRSNLSALDAVSSSTAQAFPPSATSSGTRSANTKRSSSPEPRPNKNTASSRSSRRATTSSR

SEQ ID NO: 42290 - protein, 193 aa, A.fumigatus
SSSASSRTSSSPSPSSWKRKNSTSSASRPATIRKTTSSTSRSTPSPTSSSASWKHSSPTPCSSCTCTRKPASPSTPSSSPSSPTPTASTATPPSSSPTSTTSARACTSSPSSCSNGATSFPSATSASPSSPRTRSASSAATPGCPSPCLSPSSSPFLLPRFRASIPCSAPPPSPLSSGSSRCPWPWAFCSWMS

SEQ ID NO: 42291 - protein, 304 aa, A.fumigatus
LLLSAARSTPCGEDSSTKIGSGNQRSVSSTHTLPIQSSAPHRSRSNSPLRMASNLGSSPSAQTLAVSPVHGRPPLNRKSSWQRSRKSLKELEEEYHDSDEELPDDMSLWNVPISPRPLQDRASSRGTSPDGRSPGPRPLPLSHSVSDMSVLSSTGAKSPRGSRPGRQMVRSSSAGPERGQISPRNPRIYSYNTMLSDLSEEAKIITQALEYHADERDRKRAENLQSGISSLRSSSESKRDSKATIELPPLQKCNIMIDPLPISKEKEKVLTRTRPSWLPPKDQKEEKRHLREYKKMMAMAREAG

SEQ ID NO: 42292 - protein, 206 aa, A.fumigatus
LCLQTIAALLVLQFPSPSSAFLAMANALNRPLPVAFLTLDRGAIGRTYSLASATLRYKFPRLATHLYETLRLSDEEIWEPMFRSLLTNGLDLERVSRVWDCWVFEGDRILIRAAVAILGCLQPQLFAFTQPDDQGRAAVKDILGWGPHHTGSNKPAARHSAPAAPMTGFGGSQSLNAVAGDYWILTTAGNEDGFMNEVREAGKVRD

SEQ ID NO: 42293 - protein, 217 aa, A.fumigatus
AMTFCRFWKTRRPRRIASTMESNLSSRTRSAASMATSLPETTAMPTSAVRSAGASLTPSPVTATTLLRALNSSTMRYFCSGEVRAKTISSYWQTASHCSSLREEMLGPLMRRLRRERRDCFSFSSSLVDSRRSSTVSGSAVPVKMPTSRAMAAAVRPKSPVTMKKRMPARRQAAMVRAVSGRGRSTMPKMPITVRSWTPWAKTSSLKSFDPTAALGV

SEQ ID NO: 42294 - protein, 169 aa, A.fumigatus
CSTRNQPTQVKRMIRTSVTVRQIMMVTKRVISFWINVGFSLTPVVILAMRPITERLPVSTTTPTALPLVTLVPMKAILRVSKKLSSVTSMAPSISSDSPVRMERSKRTSPDVWKRRMSAGILLPMETWTMSPATRSVDGTRICFPSRTTRASDGSRLRIEFMTCFVDQS

SEQ ID NO: 42295 - protein, 316 aa, A.fumigatus
SFPTSLSAAGRPSNSCSPEQRPLLLSSSSVYSSISASLSPSLSPPPSSLAQKYGTCIEILHYGSFSSVRLYARKPTTSPTGTSPKQLHVVKVFRRSSSPAIITHHRFEQSLSSSLSHPNILRTIDSLLNDRGELCLVTEYCAAGDLCTLIATAGATLTLCDINCFFKQIMRAITYLHDRGIAHRDLKPENILLTVHGAVKLADFGSAVCLPRIDASDSDAEAEGGVVSSYSPPRKLLWTIPYIAPEELCEVRRFDPRAGDIWASGLVYMAMQCRRLPWRMASEEEDGWYREYLVGRQGEEGYAPIEGLGEVCAGFL

SEQ ID NO: 42296 - protein, 162 aa, A.fumigatus
RYSLLTPIDKRRAAKAASAKCEKDNTREALKRIWDEYVFPNWDRAIGETRTRELWWRGVPPRHRGTIWQRAIGNELSLSEETYKKALQRAKDVRSKSHGEAGESHKRMKEWFDTIETDVSKAFPDLKLFQLGGPLRDTLIDVLEAYSMYRSDVGYVSGLHVS

SEQ ID NO: 42297 - protein, 387 aa, A.fumigatus
RKTYVQSILPSPVQSPRNLRNNAPRERANKQLPQLIHEQNAQGQGQRDEPELNGDGGGAEQGMEARNLGNKNGDDEGDKHGEGQPGVAALLADRVRGEDGEALVADGKDVAPLEHDEGDEVHALADVVEVGELLGGVAVEAVGVGLEGEDDGVEGDAGFLVHVQEEHGVGDECFHDADEEVGLGVDLEVDEVVFLMVAGREAEEVEFFLFHDEGEGEEEVREDADDDHEEGAERQRDPEEDVHQHRPDLGPAACGEQVGDDLLQILEDEAAEADRVNDGVELVEQDEVGCLNGDVAAGDDGDADIRSAQCGSVVDAVAGHRDDVVARLELLDDAVFLFGRGSGEDDLFVLADRVPLLVAEGGNAWAVDEETASRAERLLLVFVVAGG

SEQ ID NO: 42298 - protein, 678 aa, A.fumigatus
  UNSURE (540): Identity of amino acid sequences at the above locations are unknown.
TPLSGLPPRILLQWIALFLCFPNVVSSRPLIKPMACSVDWSTVLNVLLPLHGPRNRTMTESIIHSNFDILRYLAGHLITQSKAPRGFRPPSPTKLLSSLLGGGQSKDVKDSGAIGSKGPSSATLLGEFPKMPPPRANVTRSNTLPSMFPGKEETPSKISVVGTAPSKGPDSPFSLLEQTFTAYALALQSRSGNIVGRSLRARENVDRSSVNELYNVLLEDPGKIQAAAEVPVDTLFVAFETFMANAWKEHMGPVIESGALKLIQSQFDTMFPRDFEENFRRFLTEISPQNRRALASLVRLLADLLDASGNDGDRGALTAAFAEILTVEGDPMQHISLLDRLVDDFDNLFDEFIPSGASLDGILSSDQSKPSARDAGSVSSNASSFRKRFGFSLHRESSKNDGESKVSSILRTLSKSKNSGDTESGTPRGSLLRSKSIDVDTGLALHLRPGSRDRPSAASSQEHLRRPGSSQGQPPSLSSIRGISTNGVVKVRRRRRSSLSDLRPGTASTDTSAVSPRQDLRPATPVPSTNRSETELATPXTQPRPQTSHGTDSTNRSTSPTKSNSPSRLASPSRRSPTRPVTPSRKENIDPTLSRTGRPPRKKSDLAVSPTQEQKRRLRALSIPSSRNVGLKERPVLVNGSDPRRLQTLISSQRTPKLRMQSPQKVCFPDFPLLPGRL

SEQ ID NO: 42299 - protein, 99 aa, A.fumigatus
TKVDAGERERSSWLFLASADDIFWVAVRALTTSTLSLIIREHINFTRLLQSLISLIEYMVFYTSRVGYSHIKPTTARQKEATQGKTDPTTPGVQYGHRE

SEQ ID NO: 42300 - protein, 137 aa, A.fumigatus
FVFTRCALIPPSLKLPAMATVSSAVSNLPLEQLTLYQASDPYLYSIFVFYGPVTTANATVSSSRIQAHILTPAGFQSYSRDHRLPRGPVICSRQTPPPRETRRRDLSWSCCQHVEIFCRVVRTGQGMLGNNGSCGEA

SEQ ID NO: 42301 - protein, 218 aa, A.fumigatus
DVGNAVLMAGCEEGGLGEGEEGPAEENATGGHGEAWLFALVFALHLRCGRAPRTSTGCACAVVARAEDHHRATLRDAVETMTLWNPGDGRDPGQASTSGTGTQPPEGGLDIVILVVAHEEGADASVSAGYAESLKAQTSGMGFERGDAAALWPFERENLCLQACVAVSPWRVDKIVIWLTHVTQPCSYSAGFPAALLPGFGVNDKGCHGQPVYEVLFL

SEQ ID NO: 42302 - protein, 564 aa, A.fumigatus
SLEIEDNHDLQYGQYTGLIRALGAPMFLPTSRLKRAPSQPTNLSKSRIFTRSQKESLRLTMCELVDTEERYVSKLYNLVREVAEEFRLKAQGRGASSTSPDEASLAALFPPCLNEILDVNLGFLEVIRNVLEETERDAIADIGDDTELPSSMSHRTASRDGKDPIGAVAFANALLEWFPQFSQPYADYMRAHTGFTQTLNSFMRDKNSSFSKRVVETGEQRLRSLLMEPVQRLPRYSLLIDTMTSSLPLIHPAVRPLLKARDIIKDICSLDDPSSTNHDQSFRRLKELVDGWPATILPVGRLITAVDFNELSPPYHIDPSSPNQNQGIMLIYKNCLVLLAKALGSRTTARGLLADLDGAASGPGGPSALQSSGEIKVAQVYDLQTVRSMQSTCGRILFLAPTSAKARPDQNTTVDLFALELAGMYEGRASRLIEEMAKAKIEGRFSESERENGKWTLRSPTGTVGNLGILACVLEEGLDNVLGRSGLSKIRIVFDTPRSISTKALNTSDLEVVISVSSTSEDSYRVDIDSIVGVASSDIVTVDSFVPVLSKRRKFSSSYQTDGL

SEQ ID NO: 42303 - protein, 120 aa, A.fumigatus
  UNSURE (71): Identity of amino acid sequences at the above locations are unknown.
LARAAPISILNPRYLDERSSQSSKKEKELFIRSEARDGVHGHVCCIASPGSAACHSCTINQSFRNRIGDAXYTAQTTDQSWHRFYEQKHVAHQKQLPFSIGLAKPTITDTSSYPKPQREH

SEQ ID NO: 42304 - protein, 175 aa, A.fumigatus
QSTHSRSVPNGNGVNNSRLNANRMLRAKKILAYVAERIDPSYSEDPQEGALKPEEYLELYCQKMVCTASTQDDLVSFANLNQLIPPNMTLATIRAHIWRSSGDMVLYYRANGKKEIPMPGSGREGDQGSQSADATNTPHLSETAGMANGDGGSAQPSSVHSQSASGSASVSIQNS

SEQ ID NO: 42305 - protein, 147 aa, A.fumigatus
SKTPSPTPTIYYRNAASYTSTRAQGQCASDSPAYSSSRSSSNSHCPPAALTSKPRSNPSACAASQNSSPRTRTTTSPYLASRSLPQNSSPPLPHPHQRTASLLHWVASCSILSNPPPPLHPIKRTTSETKIHGSSPANHTCATAPPQ

SEQ ID NO: 42306 - protein, 237 aa, A.fumigatus
QCRDHPLEAVYRCLRCWLGRDPAHRPDSRVSWSLRRLGEWLDGDPPPSRQQRRRTLCSFWEHDHIASAGQRRGQTARLPHGHRWHSPLPAPPRLPQGLPPRNLPSTPHSLRLRPDKLRSNPHAAQRDPQPRVSDFSATPAARPPGRVHPLSDQIKPRPNRRRHRPLQQSTIAMPPPTLQPEHRDNAHPIPQPTAAAEAAAIPTAHPQPSLPNPGPIPQPAPHHRTHLPAPVQPLPPT

SEQ ID NO: 42307 - protein, 80 aa, A.fumigatus
RKKRERKTICQERGTTTTVTRVLRCDQIKGGRIYYVKRHKERKESKVKKKKKKKKKKKKKKKKKKKKKKKKKKKKKQMNE

SEQ ID NO: 42308 - protein, 310 aa, A.fumigatus
SSVTAPVDIPSPNAKNLGIQIPYDPSSLSMRPGNESFGSHTAPGFGIHLATTPGFLTSSMLNTSNNHFGTSPGDVGDHLASPHPDVVRNSMSDKSDYFSSPRQQGSNAVDATTPGDPTPTALPQSPAEPDKEERKRTGSIFGKKFRMEFPKKLGRTSSEVKPQVPGGKGKGAPKEPWPVKEEKVFINHLGGFNERIRHESDEFLAPNPDKRFVSAITPSPNNETPMLDIPPRTAVIIQEESGDTAVASDLYRGSVGSIGQEVDRLEKSIPMWLAELLLKVRFLQPFEFELWLTLGRTKSLPRNPSKSPLC

SEQ ID NO: 42309 - protein, 98 aa, A.fumigatus
ESSGEARTVATWLSDMGKPDDDLVNSPGTNSHTGLQAQILALEWPQGSSVSAFETHARRLRFQALGIACRDRRISALLMGHHQDDNVETTLWRLCTGA

SEQ ID NO: 42310 - protein, 470 aa, A.fumigatus
GAGLAGIPPIARIPECHGLYGVSESGSMVILRPRDNSAGAPCARSGSTTTSQVQGKDEGKQPGFPMATGGILLCRPLLAFPKASLLATCHQHRIPYVSDPTNFDPTLTPRNAIRSLVSPTFPPRLPRALQAASILSLIKSSHALIEDAIAHSNNLLSQCRLLHFNPSTGTMRIRFPSLQQQQKQQQFPLPTRSPHFQTQVQSLSLRRITELISPHPYNHFPLPSFEKFTTELFPSSPSSPPTDRLPFTLGGIMFHPFQPTSTSAPDQTNNIRDENTWLLTRQPYMRNRAPSMTLDLPSPESEDFYSPWKLWDNRYWVRAAVVPDKGGVDSDMCAHYTQSELDEVRRCFDAQGLSLVVRPLRQSDSQAIRAMIDGQGRGKKQHHPALAVALKRLALEAPGQARFTVPLLVVQKISGGNAEQLPLALPTLSCRLLSASQAQRLLESSVPWTVRWQWMYKMIDHDSLKLMGWL

SEQ ID NO: 42311 - protein, 273 aa, A.fumigatus
RSCSREGSLDNSDLCRECGGRGQLLCCDGCVNSFHFSCLEPPLDPANPPEGDWFCPKCSVSRPIRKMVDKLDRLANKEFMLPASIRNHFAGVKTGSRPEDKNDRTRYTECSYNLVNGVGRGVCNGFYDDPNLRKITDSDGNLIICYACGRPSDGDKPILQCDFCHLNWHMDCLDPPMAKPPQQENKSDKRWRCPMHVEHEMYYYHWNDEGAYDARKIRRPARPRMIDIEILPSEEESERIENEEDVGGGILYRVSEKGVEAAFLAKVKRSVIL

SEQ ID NO: 42312 - protein, 174 aa, A.fumigatus
NPFLSLADYLDRENAEFEYNKQQADKYFEEARAQRDELHARAVEFYAAQQPRPLPDAAEAIDNSRSAADREAAKNLLAFAAQNQTEPADDNSRITFLIDALRAQAPNDLPEAHTEIESLRNLQQLIERRIQALSSQTELEATTAQVSEAASSPFPNFAIEHGSNMDEPVEATSA

SEQ ID NO: 42313 - protein, 215 aa, A.fumigatus
STLMPFLKSPWMISFASQRTRYFKLLCHLFWWSNHVQVGLPTGNNFGITAATPENPDSFEIFKFVVQPTASGTNAAPPAQPQANQQPIVNQGQARPVDPRSVNSDQLADLSSRLQRLNDATNSIARDASSQSSKAENRHVELLQKMATKEQVANLDARLQKIELLLQNIQRDLEGKDYRDRFNQLHENLRSSHMSLAENLQNTILNGKNSMRIPP

SEQ ID NO: 42314 - protein, 699 aa, A.fumigatus
GYRSQIKENTNGNRCPLLLVVLRSDLDAHAMAHRQQGLSRTLPKNFTFNSTGTEEPRTPEHASIHVDGPPPPPRHSSCRLRRSRIRSGTDLVAQVEYDRTTLTANPSDIPLPSIELPPSYDASIAQSYPGSIAKDDRFLAPPRDRMALKTPPAQIRGSPSELTDGWPSWDSQAIGQSLQRPGSACSQASDSSISSCETFASRRSVGGSCTSAESDSYDPFFYLEIPPKQLAEKPSVATANHKKTNRGFPKRERWTLDMDNHLWNTYQLYIQDPTITPFKMTPGSIPPLGVTHRVAREAKRSWERKRYRLARPFTFSVHQPQQPQSGETTPTPRTESPKNAWPKTEASTRRRLKLLCKRKFSIAPHYQRLMQSRSPSPFLDLFSQPSHEEHPLDSPGNSSTTYATRDLGVSLVSSSVPGPLSQLAVEDRSPQNPAYDWPRNQTVPQASWEEPLARTTQLQAEHPGSIPRLGSPFTYHTWGPTSSRKKNSRHTPRTRRETIHVTGSRLCSPPCTEVLPATDDSNIVYSVPRPTEASPGHENQDHLETLIRDGKLSDIGNRRLRIRSRGATTSSIAPQNLDQLFSPPSSASRNEASTTFVEKALPNPLLNLSGENLKRLGSPFKVDASKRHEGRRIRHKPSLSDPFASGLLPQVRPVNQSATLKDQQNMTGALPYDPTEKGISDAERIRRQILNMSYSRRQC

SEQ ID NO: 42315 - protein, 95 aa, A.fumigatus
YVTETKKVQQLSRGENSPVEGVEFSWLKFDASMFAEAENPSLTCATKYCDVTFECHCVLNLSIFRQYVIGYQMSPEARTSIRPSLFHWRLRLVNL

SEQ ID NO: 42316 - protein, 186 aa, A.fumigatus
LVACTESRFTFSCIQSNPNLSVSETMQAKQLPDHHVREAVNPRTGRRERVFVNLEAVYPDYKDPTKEVSFEELRAMHRGWMDKDWRPQMAPFKKIPGNIAGSERPAGNVIEQSLDQGLSEQFSQKLKVKDAGSQGTQRAIEDGLNESKANKARKIKLREVKGETQTSKQYLVIAVSFPNSEFLTNR

SEQ ID NO: 42317 - protein, 220 aa, A.fumigatus
FASTISLLHPLWSTWKKRSPTHARSTTPPVDCAAGRNKGLSLIDFARGIDMRAFQPSVQFIADWETGEHECNEIREMRPWTHQIDLYGIAGTVHVMLFGKYIESTPVRKSEGGTVSVRTYRIRESLKRYWDREIWTDVFDLLLNPCTERWARMELDAAGPDQDLRGAGNQIILPVTHSMRYVREKMEAWLLANAEKKGLGLQIRKLEAVFAEKKKKLERS

SEQ ID NO: 42318 - protein, 437 aa, A.fumigatus
RYRVALDKSFHDSPTDYPFGPHACLSVAAMAASEDLINFDIIENQKENIQSLPGGRSAKELARIFSPRDSSDKLAAPSPNETRTLNDAIRQEYEAELQAIDDSDDPLDIYDRYVKWTLNAYPSAQATAESGLLPLLERAVRAFLSSAHYKNDPRYLRLWLHYIRLFSDSPRETFAFLARHHIGEGLALFYEEFAAWLEGAGRWTQAEEVYRLGIDREARPTERLIRKYTEFQKRYEQRTQDHGPSSPALPAVRPALAAKVDPFSLSAAAPVADPQAQRPAPAAAAAPRTKSGKPKMTIFSDADSAASQPAISGQTKGWDSIGSMRERRKENSVEAKPWVGETLKAGKKAAPKEKMPIFRDEVSPCSLCCHPFLKFHIFTITGLIGGMYRISVYVFMYSVKSKSICLRNDASKTTSRSSCKGSGKSTNRTARACFRQS

SEQ ID NO: 42319 - protein, 580 aa, A.fumigatus
PLTNCPVKMKFDSPTGGKIRRKSTAEPTMTIHTRAATDEIYSIFNQPLKAETENVADSSDFEDDDYTSAGESTCTGRISITSSDFCDDETTTFHRSDDEAEEEDFEDHTHAESVVDGEWTQFSSKEDPTHSLGVDPISPHGNTLDAAETSRRERFVPEMPEDYNPPYGPYRDPAVVAQNRLPFMTPIVEQTEHSLPSMTAARNALYNTKTPSKPQMGNFFTTPLIGATPQQTENLTVFTEDVAMSPTVKKARSGLKILSPLKEQQQQQHRVIINDSQCNPTDRSIRESILQAVDPPLASYPGYHCHPEVESHYAPAIQKFVKRHVKRPRSGDEASFDVPILELPGAQRCYIIRRELGAGAYAPVYLAESVDSLENYPSSDSEAEPADDDSPDSQFTNGKKAVTRSSSRYGFEAIKLEVGPPNAWEFYMIRIAHERISQLPELSRATDSIIRAHELHVYKRETILVEDYHGQGTLLDLVNHMRNESIKANGTGEGGLDEALAMFFTVELFRTVEALHSCGILHGDIKADNCLIRFDDKPTAPSLVDLEEEITDPREIYYSPRGLCGWAQQGPVAHRFRPRY

SEQ ID NO: 42320 - protein, 122 aa, A.fumigatus
DRRAVFPAAMASSQSFAKPFQKILDPTKIGTWNVVRRPPIENHSVIQGKPREQNSNAFKTHQWKEGVRLRKALNAITHGKNIFVYHNIRTNQVVYSLTRYLEVRTAIVHPSQSVFLICFVQM

SEQ ID NO: 42321 - protein, 251 aa, A.fumigatus
KNNVLRQLIYHGKKTVPATLRKDMWVPYYSVHFTDSKVGLRAYHLLREFSMQRQLAPPREMITITEQFLAQKRPRNPEEAKKFDEKYANKVGWLMEKKDRARAVMDQKATSVADIAAVLSIQEDEIANGFADGKRGYLTPAARRRRREARKKEHEKSAEQAERVAAFAQTLSTPEVDYSIEDPNEDAELLGDNGVKILWADIHDARFAEKWPDRVWHGELDLSRDHVMPGEKQIPGKKDLLASGQFKEKQA

SEQ ID NO: 42322 - protein, 432 aa, A.fumigatus
ITCRIQGSSMRSEPGHVCDLFVQVGLPSRNPWHTWHSKCSTFLSCPLNASILTDYSYYEHLAPLSPIVIPDFSQPSTHRTLLTDEPVLAVTILTTASRHMKPKGDGAYTRSFYIHDRLWSYLRGMIERLFWGQEKFGGNGIGISKPRSFDLAPSAAKVSLKGNLRSLGSIEALLILTDWHPRNLHFPPGDDENTLLDLDAHTQARLEKDVEHDGEPTHHRSSQTSGEGRLAFQKWLEPAWRSDRMSWMLLSTAQALAFELGVFDQKSEAKTANDSPAEQTRKRRLRRLILVYITQSSGRLGIPSMLPLPQWTNDIQPTPASTSKGGDTNIDRMHDCWIGITKIMYQSNQLLFASNEQTSELIRSGRYRDQIDRFQPFLREWRNNIDTIDRKYSVPDLLLTYADYLVAPAMRHILMIEYEYTRKWLLIFDCRL

SEQ ID NO: 42323 - protein, 591 aa, A.fumigatus
NRKLRHLQGISIRNLVITPPLSRPRGKTIDDEEIPNSLQSPSKLLAQSASRPLPQSRSFADLKTVPATSDSRDDAEQQPAWRLRRRSMLPWNDPNPQMRQIKLEDITKTRMADTWFSIHCDGIDTPVYVSEVVENATNPSFKAFDLNVCGPKVSRADCLTLKLWAKSTTMKEYVLLVELQLCLQSLHFLGKSLDSFHQPLPSNSILFHLTDGVYTNLTGIPSSNTLIPSAASKFSDGVVLPTSSYDALMRLANLDECIQDALATREKLESQISAILEQNHHAMTLTSDVSRAQDKLALTKHAVAAGKKQLRATWKRKEELIASIKARREAMERGRYSQEKARCHLPDAQQKLASCSQVLKQNTEETKGQIRRIAEDLLAIYPIEPIPDKPLAFTIAGLALPNSNFGDIDRDAVAAALGYTAHLVYLLSFYLSVPIPYPVYPYLSNSLIQDPVSASLPQRTYPLYPVNVQYRFEYGVFLLNKDIEFLLNKLSLRALDIRHTLPNLKYLLYVLTSGTSEIPARKSGGIRGLLQGRLTPSLSRRGSEDSVGYTESIFPRKEVRPSSKLNGDLASDKAKQTSPHFPSTATSYQVT

SEQ ID NO: 42324 - protein, 80 aa, A.fumigatus
STSLCCAGRRRLYTIMMAASNTQQENGIYAQNGQAQKSPSPQPQHRRGYQACDPCRKRKVKCDLGSKLYPIFRLYILHGN

SEQ ID NO: 42325 - protein, 279 aa, A.fumigatus
ECINIAPSTERYPPCFPSFSPRQGSSSRLQGQAGLCYLPCPCETWWPQEACAQGCHLRYVAHSGSFSMWEKLGLTMVSSSGKPTNMGVNQLKYQRALRATAEERVGRRCANLRVLNSYWINQDSTYKYYEVILVDPQHKAIRRDPRINWICNAVHKVRLQRSCNSARFWEICDALANIFCTAPREPWSHCHRQEVPWYQQGSPLQQHPCWPPSHLEDPQHPELLEIPLDVENWVFMGVGGYGKSLSSRMCLIRRKLASMTLSLNHQGASLMQQIFRIGC

SEQ ID NO: 42326 - protein, 620 aa, A.fumigatus
FQALVPSNPTSPATDHTGWPSGTSPGLSSPMNWNHVGNSSFTWGTGIWNSESRKEPPPRLSEIVPSPTMSNASAANNYFSDELLSPTARTTSGESAIPFSIPLHPTPKTYRSQSYSVGQMDPEYLNTMANKSAAPFSGGRVRNAGQYSALQHRSSRPSLLGELGHDPATLGRVCEDDDDGGSGNSSDGSLNAYSANQARTIEQLSRENAILRQAAGQLDNRLRDRAMSSASTASGYAVGTNLRNLHRIRGTVPEETDLAVEDLDEVGDMTGYSNIHSSLRKRFSEHSGNLEKQLPSTLNPLENRALESIRKANWQTSLGFGSIADIPQSRRHSFADIPIRHASVSGDSQVATTSRAGMGDREDHLANISDSSLSNAQSQNREYHRLHMASRPEEHEMEMEYLRARQFAESYFARDQALRVAEGPSAVPTSLHQAYTMPNAYVRHQSGLAHGHQNQLLYIVTFKCHRADVFYIQEDTGLQVKPGDLVIVEADRGTDLGTIQHANVSLQRARELKQQYAEEHYKWLMMFSRQGQNGTANVTGSVPALSGRSTIGGMGPHGPHGVQDLAGDIKPKLIKRLAQNHEILTLRDKEGNEAKAKRVCQQKVAEHRLNMEILDAEFQM

SEQ ID NO: 42327 - protein, 184 aa, A.fumigatus
GVRSGHRIHGTNCDNRDWKKLTFYYFADSYINFNSLVTDLFKIYKTRIWMSAINPASFVTPPTAGLPPPGGVANADGRVYGAARDGMDVGRDTVGNKIGPLRSTYIDPYQSFPHGARQPESGLGELAPSADPFSPYPPNAYGGTLDTGYVDYAAHSPGVGSGPSRVHNAPNDWTTRFQGLSLGS

SEQ ID NO: 42328 - protein, 68 aa, A.fumigatus
LRQLNAIHRASRPSRPDKARRLGYKAKQGYVIYRVRVRRGGRKRPVPKGATYGMLRIQDLSQCGRSWD

SEQ ID NO: 42329 - protein, 112 aa, A.fumigatus
TPTGSTRTPPTSTTRSSSLTPNTRLFAAIPASTGSATLSTRFVYSARATRRDSGRFATLLLTFSVQHRESRGLTATGKKSRGINKGHRYNNTRAGRRHTWKIHNTQSYWRYR

SEQ ID NO: 42330 - protein, 1013 aa, A.fumigatus
WMNRNDGNGRNCKRSKSSLERRTHNRLSTTLSRPVRSTALTSLPLPFLKLPSGVVKPPPARAPGYWLARPAGFSFRENVPAYEDFYQRTRLDWMILFDLRLWKKTRTDLRDLYIGTVVSVPQFKRILGLRMSALYTALAQLYLIADREPDHSIVNLSLQILTTPSITEEIVRRGNFLTKVMAILYTFLTTRQVGEAYEVNPNATLAFDAGTVTNRRLYHFFLDLRYLLQSEYVQHHVRTEEQYLSQFLDLVKLSQGICPNIRAVGEHVEYEPDAWISASILMREINRLCRQFCEAFRNPEVDGGKNLFRAIRMATVSAIVHSAGLERQRFEQAEVKEYVRFKLLPCFDFEVDQTGQIPRHRVVDFVVEKGSISFHHALHYTLSWLLECARNVSGGQMRDVLLDAARMANDNIIRDSSLTPDDFLLTMFDYPLRVCAWLAQMKAGMWVRNGLSLRHQMSQYRGVSSRDFAYYRDIFLLQTALVTCDPSRVLASIADRFGMVDWMTRNYTPRAGYEDAQIIDVAEEFVHLLIILLTDRNSLEAIDDNETVTRDNIRRDIAHVLCFKPLSFSDLSTRLSDKLLDSSMFQETLEEVAVFRPPEGLNDTGTFELKPKYIDLIDPYSAHYTKNQRDEAESIYREWVAKKTGKKASDIVFEPHLRPITSGAFSDLSHFTKTPLFAQLIHHCLDYVMSSKDCSPNIPSTRVETFLQVVLHLILAATLEDNSQEDEMADEARESFISNALSRARGTQAGNLTIIGLLEKISVMPEFSACGPKIRHILKRLWQKRPRAYASATASLTFPFDRVDTNSPAIDVDSEKELKKKQALERQARVMAQFQQQQQNFLNSQGAIDWGEEDFSDLESEPEAAPEAKLWKYPSGTCILCQEETNDSRLYGTFALVQDSNILRQTDVQDPDWIREVLKTPLSLDKSAEDIRPFGVAGENQITVKRLDSTGGEVISEKIGLSKGFDAKNTVRGPVTTGCGHIMHFSCFEVYYAATQRRHTHQIARNHPERLFL

SEQ ID NO: 42331 - protein, 609 aa, A.fumigatus
RLAVGTSCTFHVSKSIMQPPSVVILTKSRETILSACSFKEFVCPLCKALGNAFLPIVWKGKEESYPGLLSTTVPFNSFLSTELRTALSQPQNHAILVGEDSLQLQLYQDMFLDYLQRAFVPPVANQIEQLVSGSPPPTTEHPPQVRMPMPGLFPSHEDASASSPLQPVSSTPDESPMFELLQIYKRLKKTLRTNHIHSTFNHPPETIHSVNDDLVHTDSLFSSFGYSIAAVEIAQRGVESEAGSTLLDKIPQLTLTHLRVLAETALSYAAVGCLYKSGGNHSRAADEFQEIHRQKICQLFVGYPFVVGTALLDGARDIEPMLAKDTFVFLAECSLSLLPVLKIDVHHLVQLCYVAEIVKVAMTYILHPQGLKKELAEHGDAHYLLDVELSDERYEYTRHFFNAIVGELRENSFRHDEGSSFAADSGYVKDGEDSATPGIIIALRRLVSSYALAFLRKVVILLHVQHGVEFLTAGSNDMGASELDRLTKLLQLPSLDDIFSSVNPAKKANELDAVVAGWISHWNSSRVGTRITDHQLWPSLPHPAIFELIGLPKYYDILIEEVNRRRCPKTKKELTDPSICLFCGDIFCSQAVCCSVDNRIGGCNQHLQK

SEQ ID NO: 42332 - protein, 61 aa, A.fumigatus
VYAISRSSCFIYRLLSVYINDLHDVNAFLPIIYPYEVEHSESPSFVPPHRAPSHHTDSTQY

SEQ ID NO: 42333 - protein, 585 aa, A.fumigatus
MMLTECERKLGEGLLRLPFEHGCRYGPEAERDLLELLFRSLVGFDEDRLRQLFPNGFPEGPWKLAEAQGAQEGAEYTEAARGKRCGHIFRAGEATYRCVTCAVDDTCVLCSKCFDASDHSGHQYQISLSSGNCGCCDCGDDEAWRYPLFCAIHTDRGDTKGKQRAQTFLPPDWAENIRLTISRVMDYFCDVISCSPEQLRLPKTEDGIRQDEVASRLTGDWYGGGDQEEEEPEWACALWNDEKHTIRDVANQVARACRERIRFGEKKAYETNDIGRTVVRQSKDLAQLLKVSQVLEQIKVTTTVRSARDTFREQMCGTIVEWLSDIAGCTVLEDDQILRHVICEELLSPWRQGSGAYNASIGLKGIDDHARQDHSPYHTLMLAAVAPQAQVIFAPEADIEGDEEDNGNGNEAEGDDDEDHADTHEDADDEDEEMEIDLNRLREEVEEDEDMVMGTIDDSVTLEMANMLEDMRQRRMALMDEQERREREELQAQQEQSRAQDAQQAQHNTLPAGEEHCADISTVAIPKTPLRGGQAPSSQGARVLAGSACWLFVQGERTCLRGLLSAYATGLDDSLRSEIVEENAH

SEQ ID NO: 42334 - protein, 97 aa, A.fumigatus
EVLTPHTTRCGKNVGLFINIRKCAILYLHNKNGSWHFAPYLDRHGEVDPGLRRNRQLILNQKRYDRLLRDVWLNHNIPATISRKLEADINNGGWETL

SEQ ID NO: 42335 - protein, 494 aa, A.fumigatus
LGFVSMIRRSVTKVDFARQLAEQRRESQQPPTKRFKSAAAPKGTKLPTGYQDRAALLRQEQDESRSDIERRVQALEEMVTLGQIDQATFDKIRSELGVGGDLKSTHMVKGLDWELLRRVKAGEDVTKASEEGPDSAGPQNIEGLDQAEDVDEEFDRVLEEKEQTVLPSAPKEKKEKKGTMAPPPLPAKKTRDEILRELKASRAAAAAATTTSHSPEPVLGGKFKRIGESKVEKKRFIEQDENGRRKEVLVITDAEGKTKRKVRWLDKPGEGNGLLVPEKDTKPLGMEVPAEIAAKVAAPPTDQDDDIFEGVGADYNPLGDEDEDDSSSDQDEGQTQTTENTVISTKEEEPAVKPHKPRNYFSTSAKDEPPESDRRANPLTTDPTLLAALKRAAALRQSSPSAGAVAGEGEEDVDNETLLRRKKFLEEARRREELDAADLDFGFGGSRIEDEEDDEAIVFENEGGKKRKRGPKKKKGDKNSAADVLRVLEGRKKD

SEQ ID NO: 42336 - protein, 65 aa, A.fumigatus
SDLVVKGLVLNFLQLFGKRFALMVGAMTSGFCSLQLNYCQHMPNTIDHYEGTNLRLPEVRIGLQL

SEQ ID NO: 42337 - protein, 328 aa, A.fumigatus
RQNFQMDFDFFADFEDTEKTILLFVPPHVHANTRQSSVDPFRSVLSCISSKRNFVTMAKDKSEKKDKREKKEKRSEKDGVHKSKKDKKEKKDKTVLVEAVEQELTSKVLDGIDKAVAAETAVNGTAEAEMEVDSRPVGALVPFANPLVEDKQAKKVLKSVKKGEYSENHLDNLYIKSSISQSEKTSTGLIVYCVANNLLAAVNKCLKRGVKEVVKALRKSPTPAANAAISTPTGIVILAADISPMDVISHIPVLCEDHGIPYVFVTSRAELGNSAATKRPTSVVMVVPKSASKGKKKDGESEADGEDFSEVYEELVKLVQKESKKVNL

SEQ ID NO: 42338 - protein, 269 aa, A.fumigatus
KSFVVGELALAYNASSGTTPENARVRLDNFQVLEKVAANPHFVQEEKGSGDEKRGQYSVLLSNITRSSPTVAFKYQVHIDQLEASIYCPVIFKPAWNLEEFQASVIIFYSMNSSFASSVPRESITIKNLTLTVNLDTSPEEGREPAHATSAVMYPNSGATFRRKQSAVTWKIPELEVRTGADGKLLVRFATSTSWPRKGKVDAKFELQTADAGSRLGISTMSQHEDTPQTGTDPFADEDGSLQASDSLSTSWEEVPTVRKLVAGKYVSY

SEQ ID NO: 42339 - protein, 74 aa, A.fumigatus
NPWSWTCALYLSRNASVVFIVGQRAITATRFNPPIHNQFLVTPLTQTIDLTVAYPSTSLQHELDPFHDPNRQHS

SEQ ID NO: 42340 - protein, 71 aa, A.fumigatus
LGIDTEKEELRVQISTLRYELENIIQERDLMMLRHDKELRDLQLKADADFRKAQVCSLVVVNGVGHMLTIV

SEQ ID NO: 42341 - protein, 641 aa, A.fumigatus
LQAAESASHRANHKSETLAKELKEVQDQALNDKVGLERKLRSLQDEKQNIQEELEETQAQLLDQERQHKHQINELETIRSSLQKTLEELQNDLQNARNSLQSTQEKLSQRDMDVANLETENIRLKAEGADGETMSVLKREHSDQVAHIRNLETANREQTAELRHLRKVQKNVEVVEEQKKSLENQLQLMKEVESELNTLRIQKQILDDERSSWTSLLQENDEPAEFDSPEAVVKALLQERIEKATLVDKLGSIEAQFLEKDEIIKSLETERANLRQELEKLRAAGSTTGGATAESRIRARLERQRALAVKEVEYLRAQLETFDTEEVTLNAEQSQFDQRKSEQIANLEKLVDEYRAEVQKAHEELAKREAPQQEDTQARGVKRPLSPAESDAENERLSVLTRKNRTLQDSLSKSEQAAALLRKELEATKTQLKSLKAKSRTRILELRDNPTAEAEKLKFSTIATLRAENRDLLAQLQANHADVKVVPVSTLESMKLELNEMEKVVADKEKRMRRLKEIWTAKSSEFREAVASLLGYKLDFLPNGRVRVTSMFHLSPAYRHGDGSASSDSRGPGSMGNGEENSIIFDGENGTMKISGGPNSLFAMEIKHLIKFWVEERKDIPCFLAAMTLDFYDKTTRAARM

SEQ ID NO: 42342 - protein, 257 aa, A.fumigatus
VFEQVTTDPEARKHPNKESSGPVTNDSLAAESARHGGDYSQNRGAEPLGVSGSQSTFNNTNTSGATKLSSAPDAATREELDKKEKYPENMGGQGKFPGAHVPETGYTGGSTAAKRNLGINKGEYSTTQQSSRPQTRSQTQSQSQFQSQPAEASGSGYHSQYNGGQAPSYIQSVTRQHTQTKPKGKNLQEGSFDSDPNNNASFTSEIGSDQDPGRFAENYSQRKAADTGAADAARGPVEKKGVDDKTWYQPLESDQRA

SEQ ID NO: 42343 - protein, 367 aa, A.fumigatus
ISALTYQFPSLSALSASANQITQILTPITDTITTLTLENNDISSLSSIACLTSLSKLEHLSLRENRIGKVYASGMEGNSLQFSENLRSVDLSRNNIDSWLFVNELQRVFPGLQSLRISGNPLYDKPVAPSNVTNLPEKPMTVDEAYMLTLSRLASIQTLNYSKITAQDRSNGELYYLSLIGKELSAYPESAEREILATHPRYQELCEKYGAPTIRRAELAGAAVNPRSVAARVVKLAFCLHSSVSSGANQEQFRVQKIPRSFNTYQVKAIASRLFNLPPYQCRLVWETNELDPIHQEKKDDGDDWDSDEDEATAIGLGESNKLTPATEDGKFIRREVELLDSTRDIGFWFQPDTVEARIRVEVATSN

SEQ ID NO: 42344 - protein, 283 aa, A.fumigatus
PRFWCKQCKIFIRDTPFEKTQHEASAKHQGNLKRFLRDIHRENERKQRETQKAKDEVERLRQTVAGKPGAKDSGATAWKRASAAPPPAERPVSLEERKKQIAQLAEMGIAIPDEYRGELALAGEWQTVSERVIRPDDDTEEGKPGSSIGVRKRKMEGDEEEQEARQEAERFVSQGWGSRTRQYPGVQSDADLDALLNSTKDVKKVKLSAPDEGSKEKASKEGATPSNDTDQAAAQESELPSVKSEGKEAAQLATTDTPAVKQEEEAAPTGVVFKKRKPKVLRK

SEQ ID NO: 42345 - protein, 63 aa, A.fumigatus
ACLLGCDVVYHPVHRFRTLFAFRKLRFTQNPILASTHGGISRIGEWAWGIAQTSNFVDRTTRS

SEQ ID NO: 42346 - protein, 166 aa, A.fumigatus
CDEGHPVCRNCVKSKRECLGYDPVFRPQASTPSAIQPAPNPAPSLVVNPQDPTPSYPSAPPGYVPAASQPFAPSLHSESPSTSTDQQYDYGASSADPSLGGNNSTNMASAQNVTQGGLQPTLNATNATVTPSETSSYKGTSFSCGIHPLILHSSTFSPRSSETSSD

SEQ ID NO: 42347 - protein, 381 aa, A.fumigatus
VATSYIIQCIDFARFLPSESSVSRRTLFSPAPMEESAESANGPGESPKQATSSTEQPAPETIPDQTPRPPAENAPETAPQPMPEQAPQAAAEQPTETSSSAPVQAIPALDTSLPPIDKSMPAVDTTLPPIDTSLPSLDSTLPPLDSNVPSLPPIDTSLPPLDTTLPAAEANFLLSGTRASNPEPAASESTGTVSGASEHLTSHQSGHASAETAPYQYSNGTYQSQPAQQPHQASPPQKQQDVHYQQQHQSAQQYAQPQPQPQHSQQTHQQYQQHNHDVYQNHQPASSQMNAPPQPSHIPQAPIGSPMPSNMPPMASVGQYMTGYPSNVSQMGMNTNAQMRYQLPGDSNKMLSGGRHKKEVKRRTKTGCLTCRKRRIKVCNL

SEQ ID NO: 42348 - protein, 299 aa, A.fumigatus
YYILVHSHPEAVKRVQISDLLALRGIPPPPPHPITSLPPNRLEEIKAVFLATYAPAIDRFFETRWFSEKALGHLLANAQLMAEYSALIDAFNDRNLSDPNVVAQLESFEASVVWSTMTLCRHVMNVSNGSHGKDFELLATASRLDVIEALITGEHMERNPLAQWPVPEPAADPPTLPDQLMRRALDFWSSIGHFLTLHDNEASSAKEIDDTLARCRTLLDTYENRDVIYSIAIARHIGQRWADFPHSLPQHVTTNEKDAGAKLYVAQKFLEQEASGKGTTQVVKRICGMVVRSWYISRE

SEQ ID NO: 42349 - protein, 194 aa, A.fumigatus
GRLALLYKTYLSDLTPLPGAGYDQIDVHACSARNPPLRVSNVSTAVDDATADVNMFLIIGALRNFNAGMQALREGKWRGQPLPALGHDPEGKVLGILGMGGIGRNLKKKAEAFGMRVIYHNRRQLSEELAAGAEYVTFDELLAKSDVISLNLPLNVGCLFWLWLGVSAGYVCVILTIQRRNTHGTSSAKPSSRR

SEQ ID NO: 42350 - protein, 237 aa, A.fumigatus
  UNSURE (11): Identity of amino acid sequences at the above locations are unknown.
LLSVLSWRVRXLVVRTPPIAPVISLATRTYLTLPTEPELSEGCATIVPIQHRTNLMECDDDEWEEIRNFMKSLTRMYHDQGRDVIFYENAAQPHRKRHAAMEAVPLPYSLGETSPAFFREAILAADSEWTQHRKLIDTLAKAKQGLGRNACRRTLAKEMPYFHVWFELDGGLGHVVEDEHRWPRGDLFAREVIGGMLDLGPEVIKRQGRWNQGGDRRVEGFKKRWRKFDWTRVLVEG

SEQ ID NO: 42351 - protein, 73 aa, A.fumigatus
LPNSSCLTGPRPSHVPIDVSCLAIDADARTDSPRINPHATLTYRSQAFSDFPHSGKTSTNQNESHRHRKYHLI

SEQ ID NO: 42352 - protein, 94 aa, A.fumigatus
PSLFFASSAHKTWQSLSEIAELITPTATNRAEFLQECRSGKLDGVVAAYRTFDSITITGFIDEELVNALPRSVSFLAHCGKVAWRSSTKRISVI

SEQ ID NO: 42353 - protein, 63 aa, A.fumigatus
LEVTRRHLTMGSTGTKPKVLLLGSIVQYALASLPVSLNYSSDPVSSSHPAHTRHGNRYPRLRN

SEQ ID NO: 42354 - protein, 125 aa, A.fumigatus
SDPPSRRRIRPNRCPRLQRSQSAPARLQRLHSCGRRNRRREHVPDHRCAAQLQRRHAGPPRREMAGPTPPRTRPRPRGQGPRDSGHGGNWAQPQEEGRGVRHASHLPQSPPVKRGAGRRSGVCDV

SEQ ID NO: 42355 - protein, 143 aa, A.fumigatus
AAGQERRDQSKLAPECRLSILALAGSFCGLCMRDSNHPEKKHTRHIISKAEFEKMKDGVVIVNTARGAVMDEEALVQALDSGKVYSAGLDVFEEEPKVHPGLIRNPNVLLVPHMGTWTVEVRLTLQQRSHHGRHILIRLIFVE

SEQ ID NO: 42356 - protein, 63 aa, A.fumigatus
NGAFGRQKACEIDALDDIRRRNLADTPIRGSVTSYSGLNVWCQLASIPAVYRPNAMLVLRIRK

SEQ ID NO: 42357 - protein, 79 aa, A.fumigatus
HLIFLQLNTAIYYAACTPLVDSVVKGVSENRLWCLQLVWLKGFGLVSLKEPLSKVKNQKIFLIFINPLVPSGRFHHMLR

SEQ ID NO: 42358 - protein, 239 aa, A.fumigatus
KMYGKADCGAKPPRADIYGLQPAAHLPHALEHLTQVFPEQSSFLLITLSSYIHPGTSAAELPCSRNREVVGLRWTPHQFSPSKGHFPRKMSDLLSITASVITVLELAATATNYLRGIRNGDTDRVNLRDELRSTTCLVEMLRDRIEDAEDAATTSGLSRPLYIKDLSGPDKPLVQFQRILEDIIKQLSPQSKLRQRSLPMTWPFTKKDIAEKLSCLERLKSHFILVLQNDLAYGSCPTI

SEQ ID NO: 42359 - protein, 214 aa, A.fumigatus
SANDTELSAFLRDMHRFIRFFRQVIDVAPLQAYFSGLVFAPQRSLVRQTFERFLHTRISHIPNPQLDWSPRLYTLDLHGNTPESVAFSEAGDRLASGLKNGLIKIWDTGTGGPMQTLQGHDDMVNSVAFSRDGNLLASGSRDHTVKIWDTATWDCVQILEGHNGPVTSVSFSATSEQVASGSADETIKIWDVVAGKCVQIVVFTTGLEGSAVAH

SEQ ID NO: 42360 - protein, 66 aa, A.fumigatus
VLWALELSRSGARTESQNQNPTRVKLYPRIYFYLAHDCTISNIEDATTDCLCLTVFAVEIVLWAHP

SEQ ID NO: 42361 - protein, 92 aa, A.fumigatus
PVGFAKNLTADSSRVSPELRNLQNLEKHSERSLALKFNVQIFNSFRHQGPNGVHQCFVFELLGPSVDKVLNDYYDFGDTLETEDILRMTDQL

SEQ ID NO: 42362 - protein, 707 aa, A.fumigatus
AVIARPHLGQIMFAQILLNPAQATKSNLAGIAHVTSRMDWYCAVTGHLLNKNNIMTGTESFQEVLELLEKAVVLLYKELLLYQMKSVCSYYRNRGVGFLRGLANLDDWDGNLACVKNAEVVVREYSEQYCREYHKSSLRQLVDSSSEMEKYLGDIHQNLRDFIALQKTTRRNDEDKECLQDLFAVDPQYDLKDIEEKKDKLLDDVYDWVFRTDEYAVFTDWLDDGRNGASYRMLWIDGPAGTGKTMLFMGIIRKLSDQPSALSPSVSYFFCQGTDQTRNSATTIWRSLVWQLLVQQPLLISHLRDQRRNAGAHLLRGERAFYVLSDALRSMLQDPCLSPVYFAIDALDECDRKTPGLDQLLQLIESSLALSSKVKWLVSSRPEVLLHARGKQLKEIHASTASVTLGPRRLEGPVNAYIDHKLDSMKGKDGYDTETLAQLSDEIRQRAKSTFLWVALAFKELDGVDGWDAVETIQRIPSGLSNVYDLIMAQIEKGSSENQKRCKNILVAVVLAYRTLSLPELAVLAGLQPKINPRTIVEKCGSFLTISSQGVSLIHQSAKDYLEANYTQKLGSSVGQGNADICARSINAMGSILRHNIYALPHPGVDIRDVTPPDPDPLAPIRYSCVFWVGHLCKAKSQGFGNDLTEGGAVLRVFKEHFLHWLEALSLIGGMSESIRHLKELQTVVDVSHYSSLCERMLTKVIVRQRH

SEQ ID NO: 42363 - protein, 147 aa, A.fumigatus
RLRASITGMIQMDDCPVPAENMFPDVEGLKGPFTCLNSARLGIAFGAMGALEDCIDRARTYALERKQFKGNPLAKYQLIQKKLADAATDAAYGTLAATQVARLKDAGKSTPEMISMVKRQNCDRALANARLYVSPFPQILLLKVELY

SEQ ID NO: 42364 - protein, 119 aa, A.fumigatus
QLVFLTVSLASNNHGSCKSPHLISVAGGICAAREFGFNADIPLRQGDSPYSGGVFFLTIHFPTDYPFKPPKVNFTTRIYHPNINSNGSICLDILRDQWSPALTISKGIHRCEMIYFRKC

SEQ ID NO: 42365 - protein, 61 aa, A.fumigatus
IILTPFSMRRLQEIFGGNATSDEYHIGRHVANLFVVQTYEGQSDIHGEYPAGYHSLSFPTR

SEQ ID NO: 42366 - protein, 183 aa, A.fumigatus
STLCFGSIRIFPFFVRLSKIFFSPPFPKQTPFSILSERVTHARVSLLRIQTAPLPSPLELDLFHLPGSGDHLTPLLVLHLPRSSSNMTDRDRSSGTQSCPPPELPQLVAEQHVPIPPNDKETKRLIVVLSHASLETYRASHGGRNGSGRDEKYSLLNSDEHIGVMRKMNRDISEARPDITHQV

SEQ ID NO: 42367 - protein, 82 aa, A.fumigatus
TFQEYTGRVDSNADMPLSHLTLTVSHLPTSTSFFLSCLQPLGYQFIGRHDDYIGFGQKSGEPADFWITEQKPGSVFFRNILS

SEQ ID NO: 42368 - protein, 285 aa, A.fumigatus
RGRNHRSPAGAAHVAFPAPSKDAVGSFFISALKAGAKIHGEPKTRDTESGYYSAAVIDFDGNSIEAVYRPGISAKSEVSASPIGLLENGSVVSRASTKVSSVKPQSIAPSVRSEAKSCVSRATTAVERVAPSERTAPTIISREVQQAPSPTYIVNHTTHTTQKKDDSTAKTIVGSLIGAAAGAAIAYALTKSESQSQSSEATPPPQYTPRDFPQLASPSQAPSLAQEHQDYRAIDAPPARSTFSRSDARSTLTRSVSSKNPRASTIYEGTEFVPPRGRKWQCVPR

SEQ ID NO: 42369 - protein, 235 aa, A.fumigatus
KWASCLGWECLHGEGYPSESDRVSPHGPFQLRFPCNPSTLISSFPDKSRFNDKESVYSASTAKPSKANHQDHHSSRHSSHQSAARSMAGSTASSARTARQVPLPEGSVTSYASYRSGAKSGVSAREIPLPQSVVDDFEIQTNITPDDSISQVDFSRRSSYSHQSHRSKAPSHASKRSSKFDEPVQPSDSVSQVSTNVSKTSQRTIKANGSIAGGASKAPSKAPTTVSSRRGSQVA

SEQ ID NO: 42370 - protein, 167 aa, A.fumigatus
SLRCFSTRQCLLTLLDSPINKAGKLQIYIHTAKGVLIEVNPSVRIPRTFKRFAGLMVQLLHRLSIRSTNSQEKLLKVIKNPITDHLPPNCRKVTLSYEAPVVRVKDYIDSLGPKESICIFVGAMAKGQDDFADSFKDDTISISNYSLSASVACSKFCHAAEESWGIL

SEQ ID NO: 42371 - protein, 70 aa, A.fumigatus
KQQKCPNTNRIGASDSSREIPSSSASLAPYDYSGQVCLSFTVAPQSFGDLVGLISAITLSGFYSVRYPSQ

SEQ ID NO: 42372 - protein, 99 aa, A.fumigatus
TVPTTLLLLIPPCLQKASHFHPLKYFRNSSPNLLSFNELRSTIPMASPHAQTVINTIVRQIPTITAFTEIVYEDVAPEDGDLITRSLAESAVVEQHSAR

SEQ ID NO: 42373 - protein, 67 aa, A.fumigatus
NSSHASQKAPYSITVYKHAIWYTLYLDTGPIPLKQQEAHPASQHYSTSSRSSSILSQLARQPNRSKT

SEQ ID NO: 42374 - protein, 311 aa, A.fumigatus
  UNSURE (56): Identity of amino acid sequences at the above locations are unknown.
ESVLGVRLLHRESRLPWTPSVRGQRLSVIASGSIGTNVFSISSGQTLKGCGPIDVXNKRARGAIESLNTDGVSIPTFTMTGNPNFGMRFYGVKRLSLGNITMKLSGGLGIRFERDKAANSDVSMDTITVTGAGSHAVETWNIDGLTINKVVARDVGECGLLLQTTTNAKVGLVDGDNVAAGTGYATFRMANANGRLADGSYKTNVFVDKVVSRGGGRGVFCVSESGGVEISNVDLADNGNNAILIENCYGVSIRGGTVKGGGEVRLAARDEFKNNRDVSITLKVNGNTVRENPCGENITWNISGDASLNVC

SEQ ID NO: 42375 - protein, 188 aa, A.fumigatus
RLRLVLHHVKFESVVHCRQCLFAVGDSLAQQAVEKRGIAQHDVARTGRMAFYGGGNVQPFPYKLPLLTVVAVFGPLATKWFQVLQRRINLPSAQRTVVGRVAADQLLFAPTMIGVFLSSMSVLEGGSLSEKLERSYWPALKANWTVWPFLQLVNFALVPLQFRVLTVNVLNIGMIPIHVLLRFGCLAN

SEQ ID NO: 42376 - protein, 133 aa, A.fumigatus
LVVNMLFRKPKLPQANPDAYYQDDNVASDTHSQAAIAGEDGQLVDTHIPLLTWRSFVMGVFVSMGGFLFGYDTGQISGFLEMKNFLQRYGQKKSDGTLYFSNVRSGLIVALVRLFDLLCHVHLLTSDSYRLEH

SEQ ID NO: 42377 - protein, 161 aa, A.fumigatus
PGISPNGTHTAGVVMVVFACLFILGFASTWGPMVWTIIAELYPSQYRARAMSLATASNWMWNFLLAFFTPFITGAIDFRYGYVFAGCLFLAAAMVYFTVMEGQGRTLEEIDTMYVWKIKPWHSSKYVFPDQTDRRDESEKRTAGTNEHMETSGAQPETEIV

SEQ ID NO: 42378 - protein, 376 aa, A.fumigatus
RVTAIDWNIDGSFGRSTYCRSHRSEMVDHQLVVDDLCWHHCSNLLSHRQVVPGSARSLGCRIGCRCSLPPGSDVYGRVRPSAHSWFVSQVGRRMSCAVRYSANYCSTYQLFITLGIFVANCINFGTEARPDTGSWRIPMGITYVWALILGSGMALFPESPRYDYRHGKIDKAITTLSKMYGIPKNHRALNVEFYDINHKYEEEVASGQVTWVHLFKAPRMAYRVAVGVSLQALQQLTGANYFFYYGTTVFKGAGISNSYVTQMILGGVNFGTTFLGLYLIENYGRRRVPHAGALWMFVCFMVFASVANFSLDREFPRTGLTPLGWSWWSSPVFSFLGSRPRGVQWSGLSSQSCIHPSTELEPCPWRPRPTGCGTFC

SEQ ID NO: 42379 - protein, 87 aa, A.fumigatus
QLSIGTLMGALVAAPIADRIGRKWSITSWSLMICVGITVQISSPTGKWYQVALGRWVAGLGVGALSLLVPMYMAESGPRHIRGSLVR

SEQ ID NO: 42380 - protein, 145 aa, A.fumigatus
LSPVLIFFGGMVQIFGGIGEWIIGNTFSCALFFTYGTHVHIKSKAWQNIYTFVTGTLWIVQGTTLMPLFDTGIHFSSTGNFLEGQQTPMYNASIGLLNKWQMALALAMVDRFNSILFCGPDSHNLHIHDMLPSNQRLPLLRALLA

SEQ ID NO: 42381 - protein, 203 aa, A.fumigatus
  UNSURE (153): Identity of amino acid sequences at the above locations are unknown.
CATAVHKPQGVTSADVIRTLQHHFNPSKLFKPWLEEERARRNRESSYQRNRRRSRRLDVKIGHGGTLDPLATGVLVTGVGKGTKSLNDFLGCTKTYETVVLFGAETDTYDKLGKIVRRAPYEHITREAVEKALEQFRGKIMQRPPIFSALKVXGKKLYEYARESKEPPIEIQSRPVEVSDLRILEWYEPGTHEYEWAQGRGCR

SEQ ID NO: 42382 - protein, 63 aa, A.fumigatus
FHKVHGRRYSHCNWAISNKRWLYSQGNSVNCSHFSAFDSYISQGADYLSRHFSIALMLQLRYC

SEQ ID NO: 42383 - protein, 217 aa, A.fumigatus
AICASSSGTSLAPTNTSGPREEAAGEEKEVAERLLAKDDTLPVAPAAENEVPAEDSGEQETSTGTKRKTPPPAEEPAKDEEDAPSATDTELAPSAAKKQKITANGDSAPAQDELSDGSSETVTASANEPSPQPPAVKITMTVSSGFYVRSLAHDLGKALGSCGLMSSLIRTRQADFELESDKVLEYKDLEAGEDVWGPKVKRFLEEWEKKRAEANTK

SEQ ID NO: 42384 - protein, 1034 aa, A.fumigatus
RGLVCVARTTVQFQSILDKFSPHDTVFSFTKSADLTESALSSACLLHAASGSITSSSSSLRRRRLMEIAEDAEENNTTKDQTQVPSPHPDNRQRSTSHVSEATVVPPSVTSNAREAPIGDESPTVANITHNSQASDQVSISWDSRSERPASRRRLEDDISYAPSESRRSTQSARPSLRDLERATTYTPKVKRGPRPSVDGSGRPRTASNLSRNSEQRAITSLPAGVRTSSLRKGNPSPNRPRSQGSPVASVSSRTAPPVPPLLVPPLSMPISRAQLSPGAKSLSALSSSGTSNEKERLMKALQLRKTQMEKRAAESKKDGKTKNGRLTDVDENKENIDQADDKSKHDQETAAVAEHTKELCLKTQLSIKPGSIALSEEKLAPGEKLATSDSTKPDSAVGMEVSNFDDEQLLNQSLLNADNALIANPEESSETAQFHASQVSPEIEAVTTVEDLAVSVDNDTKNGPGLPSADIHVPPQNFEKAATEKNQQIVPSPSHPENNPVTGSDEALAVTNPADSILPQSIPIPDSPTSNSRLSSTPEATVIAPCPAEPQNELIPETSNADSKNVNPRKDKRKPQLEPIQVPTPDYSDDENLLSDDSFMEELKSATVEEAKPVSVGKSPLSPVYPNNNDQISSHAWKNSRAVSNPSALGHRFHSMQSLSGERSVSGPCGDVDSAAGPVLVAKKINVSSGISKRIKALEKFSNSRETSSNSGLNLAPPTASSSFEALRKRASLSLSGANSDASSIFRHGSHTPETFSRAPSVKRRDSQSSTNAACTTSSISVTARIVRDATNAPSDSKSDLPDSGVLNLQASPLTVERGPPEETITKPEERSMSSSSATSGHQSRAASVSRSESRLSVSSASKKEDAFLSKSTSDLSSSPEEKRASRASRLLRRMSSITSNSKKSVIGAFSPSVKEEESKPVPAEKPKTSVSSAAIDVGEVNVQFPDTLLWKRRFIRIDDKGYLILTPGNVDSSSRNMVKRYHLTEFRTPCIPDEDRQELPNSILLDFLNGSTLQCACESRQGQAFVLQSKSL

SEQ ID NO: 42385 - protein, 136 aa, A.fumigatus
GEGSFADAVTVSEEPSESSSCAGAESPLAVIFCFFAADGASSVSVAEGASSSSFAGSSAGGGVLRFVPVDVSCSPLSSAGTSFSAAGATGRVSSFARSLSATSFSSPAASSLGPLVFVGARLVPLEDAQIAHFHGA

SEQ ID NO: 42386 - protein, 68 aa, A.fumigatus
KNPDLRQSLNVMQDKDETSCHATNTSLAQSPCLISRLPSSLLTDILDYELSPMLWSFDLRSLYPYIQS

SEQ ID NO: 42387 - protein, 784 aa, A.fumigatus
RIARPIPRILCWFPNQRKPYLLYLVSGIDLIWVHSTPNCSLGSPEYADTYSRDSKRTTILPARARTDSCVKPLKIALMTHQVEGVTWMKSMEDSEWKGGILADDMGLGKTTQALSLVKSRICPDARTLPTLIVTPAGLIHQWERETENIFGSGQRVFVYYRRKGRLTFQDLCQYHVVLTTYGTLCSELKQKPYDSPIFGDGRAWQRIILDEAQCIKNARSKTAMACCEVAATYRWCLSGTPLMNHLGELYSLLKFLRIQPYVNTDSFNSVSPIGEIVTLTCLCILLIWLKILKSESIGRGNDAETARDMQLQGFLKTIMLRRTKSTILNGRPIVELPSVTIEDVYVALTEEERCTYAVLESFTQRHVQRYLNNGGEQRKIPNVLSLLQYLRQACCHILLLSGAALTALQSSRSEEHLAVNALCLPEEVVTRLRDNETISQCPVCLERAYSPIIFSPCGHSVCLACFGKMCSTTAPEGASTEVPVGFRCHSCRVTVDLQKVTDYSSFVRSHNFSSSNQGSSTLFPSSLKALLGLNDEGDEDDEDSGSGMDIGLEACRTDHVIPPLRYGVAPSEMSCAGKQSSAAMRKQVWENHEARVAYGHALPRKWVNSSKIEKAAEIIKAIRDQGTGDKVIVFSHFTALLDLIEVPIARSGWKYRRYDGRMTPAERGSAISSFASQPDCLVLLVSLKAGNAGLNLTCASNVIIMEPSWNPYIEEQAIGRVHRIGQERHVRVYRLLVADTIEIRILELQEKKRKLIRGFSNGAVMLGTDNLIRGDIAYIFVSEN

SEQ ID NO: 42388 - protein, 100 aa, A.fumigatus
GRPLCREIVIGPAHSQRGARVFVIIVKAATLPSRTRYAFLLILSIGFILVNTPGSESRCQLLLANISHVNVVECWNNSKLSKAPGTVSISNNMVTTEYPL

SEQ ID NO: 42389 - protein, 66 aa, A.fumigatus
VVPFHTFRGKRRPLYIREIHHVIGCPVLRSFHYGLASWNRGIWWVPKAPLDMINSSNAFNVSFTTD

SEQ ID NO: 42390 - protein, 789 aa, A.fumigatus
LETHLGDEDTCDRLGTLIKSYYESAVGSYARNPEALSIMMLTALELWIACDKSATRIHTVLCDYDACIPMEMFESLLLPFRSQMARLDRAESYLRLRKQRAIHSGPGVFRDYGTPACFAVRYFDQSEKHQGLLNTIEGCARREREEKKAELRRKRQQCANLYALYDGMQCTYEEVIIDERFNFRESRHSVSCKRCEYKRQADAMKVSVHEWPLPSNRLQAKSTVFELDVPRPFGCWRDITIFFLLDVLNVQYTSRDAPRAEHTLQNYRGLSSFFTSVQGVGRVGLLSQNKPHERTHRLNKKVLNVTEDEVCVNNGLLFKYFDFSTRTFVGNFGMSDKIAGSCMYKLPSRSTSLQQFLFRPSGKQDGPSPNTVIASQDGCPVGMSLEEYRSLCTMPLGIEIQWQNILRQLAMPSIDLKKAEACIFILQIINQVGPSTARLVTRTAHDILNDTAFTTALLGRIQDIAARLEENWEMAQGLSALSSLVLRVLTLSPSADIQEICLNTVKHLRKISLAWVKIVTEKASSTTDDRHRSDLLLRSGHLALICATTFDAEDLALVRMLENTYDTAVLLQCCMVINDTRRLLCEGSGSPLIPILYRRWQILSYRSLPVLKRNIIQRANSPLDRAIGNIWATYRAGSYWEASPEAPICWLVTGIPCQSGHGIDLPVHYNLLTGELLVNGLPLARLPSEYERHDTYRTLFGQSSLEVMPSVIPGMHFACRKKYMGHTVNLARKRLTGSEEIDLCIQATEEGHTWEFIPPRLLMDSFPDAFLAGYVHWYDVHNGYVEFRP

SEQ ID NO: 42391 - protein, 1412 aa, A.fumigatus
  UNSURE (1408),(1409): Identity of amino acid sequences at the above locations are unknown.
FVYSSDGRGPHLGVYTSQTSDGLLPRRFSSGLRALVRCPQWLCGISALEKPWISSVFNWRLQKTSARDPWRLAKDNLFLVSVKSRTAEVISATLQSIEKPSKLYCTFDSTTSSLGIELPRLRLRFELKPRSSAIQSREYQGMLIDPDQSLDTLVGLRNRLILRHESGGDRVVLIPEGQVSWYKDNGHIAVEIGWQAATTLHPYPVDNLLGRLTDNGSLHSRSMLCYLHALTSSCLPDPLTQRTGTEQALTILRSASMRSFDRLHPEASIILAKIAELTPERHYYPSNERVMQTVRWDKHLGFLAQHDSFYKEVKAIFEHDNRMRMFHPNEQVKQPTMPNIVADLLRRNEIRSSSFRVSGFGAEDHTVEYDRPYVGLDLNRNSARFFRVYSLCRILYEEIPSAREILHVDLLSKLWQSLSQTHVVHAASLPVDSNKIQYDAALILEPMTFVSSHWCSLHQLLCSRDSGLSKFQLMVWLATLAFSDSSNMFVLEILASLYVIPEMAELTLPSRGPFQLWHGYEVDEAILGSRIRQSAVLSHTPESNLHPLPNETLQVFQARKRRIAKRNRTLALQTFIRGLKDQWPIRSLTIPPQQAGPRFGDYYGTHTAMTQVAESFQIWFDNREFRSYLSDISSLFVSQIVHPVQMPPVSVPGQVKQTTTRRGFIRIDDLLGPEPILDMERPRLVGLLSSHPEYEEPAPRLMAFVDSLELQSKSQYERRYVEHLRGSISSLQQKKRRDNITMDSKQLGAALLDYFHRCEMYCERIYNSIRVRLTRFDETLDSPQNSLLLETVAGIGNWPRISPYLLVQQLTHQRWLFLPERWKASIVEYGCAITALQQARRLTTLVSFRDDLIRELQNPGHTNWDPHQYPESFLLEIENNILIRDVQEQIAREMRDISSGRNAVMQLNMGEGKSSVIVPMVAAHLADGSRLVRVIVAKPQSRQMLQMLVSKLGGLLGRPVYLMPVSRSLRLTVTEADAIFHMCQNCMEGGGVLLVQPEHILSLKLMCLECFVTGRDAIGCSLLRTLEFFKEYARDVVDESDENFSVKFELIYTMGVQRPLELTPQRWVIVQELLNIMRVIAPSVKQDYPRSIEVEERSVGSFPRIRLLQNDAELELFRRVATHVCDHGIDSLPVFRQSRAVRRAVLAYTLKQELSLEEITSVEEEGPAGFWTDTTKSPLLLLRGLFAGGILAFCFSQKRWRVNYGPDHARNPPTRLSVPYRAKDCPSPRSEFSHPDVVILLTCLNYYYAGLGDEELFLAFDHLVKSDQAEIEYQAWVVDCPSLPHTYRQLGGVNLEDRQHCVKQIFPWFRSAKGAIDYFLAHVVFPKELREFPDKLSASGWDIGEIRTQPTVGFSGTNDSRQTLPLSVQQLDLPEQSHTNALVLDYLLMPENSVALSSPRGWKRAVPXXVDD

SEQ ID NO: 42392 - protein, 172 aa, A.fumigatus
MRRSSFWQRFVHTYPPIPHIKRASHASKSTYVRHPEHSSTCPTSEPAFIRMVLRNLSAPSLEALCSKEQIELLDSIDHLRLQGINHYISLPQIIVCGDQSSGKSSVLEAISGVSFPIRSSLCTRFPTELVLRKSSQVGVCVSIVPHSSRSESEQEALAHSTRSLIALRVFPN

SEQ ID NO: 42393 - protein, 527 aa, A.fumigatus
RIRTGSARPFHEELDSFEGLPQLIENAKSAMGIYTNAKSFSNDLLRVEVSGPDRPHLTIVDLPGLIHSETKQQSAADVELVHEVVKSYMEEPRSIILAVVSAKNDVPNQIVLKLARAADPYGTRTLGVITKPDTLVHGSDSEAQFVSLAKNQEVEFRLGWHALKNMDTEKGTWTLPERDKEESAFFASGVWEALPRSHVGIDRLRERLSKLLLAQIATELPSLMEEIKAKMEDCLQKLEKLGEPRTTQEEQRSYLFHCSQSFQNLVNSAVEGTYSDPFFENAKSETGYKRRIRAVVQNLNEQFTSRMKRRGHYYEIDDDVDDEDEDSLGGQLFISREHYIRHVENLLRRTRGKELPGTFNPMIINDLFIEQSQPWERITSEHVREVWEAAKAFVKIAVTEVTDMSTSSAILMEVFDPSLDSVLKSLENKTCEILRAYREGHPITYNHSFTDSLQQTRQDTLMPKLSYTIRKFFNVPQLTSSQNIDGTFDLLHLRDSLLESFKADTARFAALQALDCMRAYYKVRRQS

SEQ ID NO: 42394 - protein, 510 aa, A.fumigatus
FQGQVARHGSALEPRGHFVCFLTPSLVLLANQNSDVLGEESEIDVSVYDRNNQEAFLGHVRLSLNLKEDHSRLEGWFPLSARGAGDSQISGEIHLEMLFEKTEKKQVGPNDFQILKLIGKGTFGQVYQVMKKDTHRIYAMKVLSKKVIIQKKEVAHTLGERNILVRTAMAASPFIVGLKFSFQTPTDLYLVTDYMSGGELFWHLQKEGRFQEARAKFYIAELILALQHLHDHDIVYRDLKPENILLDANGHIALCDFGLSKANLTQNDTTNTFCGTTEYLAPEVLLDEQGYTKMVDFWSLGVLVFEMCCGWSPFYAEDTQQMYKNIAFGKVRFPRDALSTEGRNFVKGLLNRNPKHRLGAKGDAKELMAHPFFHDIDWEALARKDVIPPFKPKLKSDTDTSNFDPEFTNALDNSASLNDRAAALANGFMPASTPLSPGMQANFKGFTFVNENSIDHHMKHDPSDHMDEDPETWQRAHHRGNSADQRMSGINKNNDGGEPGIFNVDDNFDM

SEQ ID NO: 42395 - protein, 480 aa, A.fumigatus
NNSLQDDDNQDTIGSNRSTPSGIATPKPDLSDKRQPSIMHSYFQVGLSSSDDNRSSKSWLPSSETLPSTNGIQPGAHATDTRDGQGSGHNSSSAGSFVMMERDEASDMNASLDCPDKKFDTQEISQGSLPPTNLPTPPYSSACSLLQKESEEAELASLTPEKGMGSIFTALKSYLAPCTATNPPESQARRHTSHPVSSISDDPVLASHFSNPSLPASADSFIPPETPLLDHENPHVLHLILKTLAKLTGNLSDLSHQKNTPPLTPRAMSNETAKNPPVTSPSSSSSSGAHPSSEQPHPDKMATSADEIAGKLNDAFPSPSETPKAEQQSGPSVGSLKGKLYVKITEARGLRPGFDPYVVCVFEWNEVISKSAQDEEEASIERREKEKEKSEREAGRPMAIPMKSRQSSNNSAMEGHDFRGKSPVTDPHWNHEATLYVSSPRRLYYWLTRTVTSLEKSRRSMFRFMIATIRKRSLDTYGCP

SEQ ID NO: 42396 - protein, 196 aa, A.fumigatus
RWRGEGDDHAGLDDTGLDTADRDRSDTRDLVDILEGKTEGLVGGTDRGLNGVDGLDEGLTSDLAGLGLLLPSLVPGAVGGGLKHVVTVEARDGDEGNGLGVVADLLDEVGGFLDNFVVTILGPLAGVHLVEGDDELLDTEGESEQSVLTGLAILGDTSLELTSTGGNDEDSAVSLGGTSDHVLDEVTVTGGIFRSC

SEQ ID NO: 42397 - protein, 173 aa, A.fumigatus
YFSSPTFHEPISPSSKEKKPNKLHAPTVTCFGALRYPIGSILLPANFLSSSLPSDVVTAFFVDSATHNLLHLTISATNFFASNPTISAESIRVASILPFFFLPFRQITSGLEWNLHNGHCSERNRFVCRCGFGKPAGIAEVSNIYFIYIAAVSSPRIYIQPGGKESAALKYGV

SEQ ID NO: 42398 - protein, 60 aa, A.fumigatus
RLTRTCSFCITAQCPAEDCNGDRAYFFQLQIRSADEPMTTFLKVSVYPPQSCWQLHRAQC

SEQ ID NO: 42399 - protein, 182 aa, A.fumigatus
SLVPPRLTALSSSLPPVLVSSRLVSPRMARPVSTLCSLSPSVSSSSSSPSTRWTPASGPRIVTTKLSRKPPTSSRRSATTPRPFPSSPSLASTVTTCLSPPPTAPGTRDGRRRPRPARSLVRPSSRPSTPLSPLSVPPTSPSVFPSRMSTRSLVSERSLSAVSRPVSSSPAWSSPSPRQRHH

SEQ ID NO: 42400 - protein, 166 aa, A.fumigatus
LQERSPSGCCLFNAQVIVLNHTGQVGAGYAPVLRTCHTAHIACKFSELLEKIDRRTGKSVENNPKFIKSGDAAIVKMVPSKPMCVESFTDYPPLGRFAVRDMRQTVAVRSQNSPSIKDLKLTSYRLVSSSPSRRPPAVPVRSPRPPRRPPRNRGLESEKFCLNNLL

SEQ ID NO: 42401 - protein, 166 aa, A.fumigatus
APCPSLQQAPPSSPPGCLQDLWYRNGPCRPCRDRYHQARHGRHLRPANVTTEVKSVEMHHQQLQEGVPGDNVGFNVKNVSVKKVRRGNVCGDSKNDPPQGAASSTHRSSSSTTPVRSALVTPPSFGLATLPTLLASSLSCLRRLTAVPASLLRTTPSSSSPVMPPS

SEQ ID NO: 42402 - protein, 74 aa, A.fumigatus
AIPSYITDSGSPSTRSYSETTNHTKSTLFLEEVHHLEATLEAMYLSKRKKKKGNNYSYLLHLLVQQIPYSFICI

SEQ ID NO: 42403 - protein, 61 aa, A.fumigatus
SPNSKVEIIVPYQFVKSYLFPLFITHIDTYSIQHWRTPPLPSQCGVYQRSGGRCYCDKGQF

SEQ ID NO: 42404 - protein, 87 aa, A.fumigatus
DSLNLFTLPVCPNCGNSLTISRGEPTREYPLGVNRFECRTCPYQHLLKHGRQEKTTMKQKEVEDVFGGKEEFANADSMASKCWMIAR

SEQ ID NO: 42405 - protein, 108 aa, A.fumigatus
LLIFFCSKEEKTHINIVVIGHVDSGKSTTTGHMIYKCGGIDQRTIEKFEKEAAELGKGSFKYAWVLDKLKSERERGITIDIALWKFQTPKYEVTVIGKLDSPRYVLVL

SEQ ID NO: 42406 - protein, 286 aa, A.fumigatus
LTRSEDAPGHRDFIKNMITGTSQADCAILIIASGTGEFEAGISKDGQTREHALLAFTLGVKQLIVALNKMDTCKWSEDRYNEIVKETSNFIKKVGYNPKAVPFVPISGFNGDNMLEPSSNCPWYKGWEKETKAGKVTGKTLIEAIDAIEPPVRPSNKPLRLPLQDVYKISGIGTVPVGRVETGIIKPGMVVTFAPPTSPLKSSPSRCTTSSSRRVSRVTTSVSTSRTFQSRKSAVVTSAVTPRTIPLRVLPLQRTGHRPQPHRSGRRWLRPRPSDLPHCPHCLQVL

SEQ ID NO: 42407 - protein, 91 aa, A.fumigatus
LHTVEIDQSTRRPNQPACWPAVTIELLASLLQGTGLSAQVTHNRTDRNERFAIIQEFNEGRCQALITCRIGLSGISLQGVNIVILHIPSEG

SEQ ID NO: 42408 - protein, 387 aa, A.fumigatus
RCVNNRYYLLYGENVTAFPDNFRMIAGDTYLRDFPWPIPDPPKSEWTGKQGSQEALRQKAIGFNCLNYALDPEPSLGRHFLPNKTYLDEHCTDGVRFELMFPSCWNGKDVDSDDHKSHVAYPSLVMDGTCPEGFETRLVSLFYESIWDTYAFKDKEGYFVIANGDPTGFGYHGDFMQGWESGVLQQAVEQCTNPSGQVEDCAVFNIQSEDEQQQCTVDMPPALKHEKVTLTSGGLPNNLAIQWGPAYASDVSASVSSVVSSALSAATEAVASATAQLSLHVSAFGNNLQISKPTSTWTPTPTTSYVESAVTEAVVYVEQEIIVWVDGEKNILGTGTGSLETLSTTTRTTTRVVSTVVTLPTETAVKREEHVHHAHKRHGHGHLHQRS

SEQ ID NO: 42409 - protein, 168 aa, A.fumigatus
SSWSRNPNTTSKMTASIFAFLLAAAAAVSASTLPSPTPVQTPTTLATTTAPPITTPAASNPTCGPGSTLIHTTDCTMGTPVSYCYSAPPPISCSTGFFPGVWHPGHCIEASTCYPVDASWITTKCSNGGIPWSTSTLFEGVLAGETTSTTISGEFSFAHPRLSLAAQG

SEQ ID NO: 42410 - protein, 533 aa, A.fumigatus
LPIREHGNGCGLNGNDCRPFSASTVAFRCPANCHDVKLLQPHTVGNQTYSYRGLVVGGPQPGSSEPGVYRADSFVCQAAIHSGVITNTVGGCGVMKLEGAAHSFPGSKQNGIQSVSFPSTFPKAFSFIDLASSQATCPPDPRWTLLGITIAALALLWLFSTSPSVLFFTTFFMLFCQVGLVSDPPSIPQFADLVSTLIARLLPASFVVYVLYKYCARPLLTPLSLPKFQLTKMFLYLPPAFIGALNNYTFARLIPLERLTPHDIQRQPGAKLALALVIPTVVTVILSQAWQIRQGGLMPHYLKVYCTMGLILLILLPLPGLRLRIHHYILAILLMPGTGIPTRPSLIYQGLLLGLFINGVARWGFASIIETPAALGELPGFDGAKGWWGATYPNITDASVVISLPDAGSHGYRGNGNITFELWERERMAQLDVDGISVLVNDVERWRGYLDEDKRGEFTWHRHGHNGLELFHGPTIESDPDSRVGVTDVKDDDKPEDLFFRFAFLRGAEAGEYGPAGVWLEDRSWLPPATPKA

SEQ ID NO: 42411 - protein, 166 aa, A.fumigatus
YLCHRGHLTMIGEGPEDGSRVYISPVLDSENRTADPDTSYDCLLPRDEEGGATYVPVWLRESSKSFRWGWVPLPIRKVGRATTDWVKGPTPLHSLLLKPLFPHIQELPVRYLNRLFPKRKHKISLLLLLYIAWFTPWAIVLLHSRSAGYIEGYGRPQTLSCSTTFW

SEQ ID NO: 42412 - protein, 205 aa, A.fumigatus
KKKDIFGFFPQTIQGADILATSSEQKYRVFMPDFFEGQPADITWFPSSDRRHKQKLGNFFQTKAAPPANLPKIPSFVDEANKLAPNGKAFESWSILGYCWGGKIACLSSAKDTKFKAAVQCHPAMVDPNDAKNVTIPMAMLASKDENPKDVEAFGANLKVDHYVETFSTQIHGWMAARSNLEDEDVRKEYERGYKTALSFLQKHA

SEQ ID NO: 42413 - protein, 979 aa, A.fumigatus
CKAYFTLRGAPAQRCILINLIKAESTTTPNAQSVKNPDRKGHCLGSSWTRHIHHSGEHGGGQDASKSTADTLARSHNAYVHDKPSSETHLSRDDIHAIFSGAPYFLLEKGKHGLWYPHVIFPWDDHDPTIQHLWDRKLLPHPSYTLCTLHAHLPVPEGFLEGDPPLLLDSWKRTGAPKRATFDIGIFEVPNMLAMSGIEPGTVGFRYFLELPVADSVRFVHTGTSHPHTNLLHIHSLPAVQADELLEHYHEPYSQCLDGTIHDRKKLLGDGPTAWKRIGLRDINFKAVVDRLETLRNLRHKLLYETTQKTILDVETAQDLYSDLFSKFLHSPPRSMLKDLDSTHGLKAEIKALTMVLATPGAWFDFSLVDWRFRIGQLLWEAPPHVDGDFFDPSILHKPWAHPGLEQKWFLIQMLLAAELLLRLDAIVKVGLLESSKDVSVSAQDVNHFDKLRNPKVDWDLVVVRRFFDSFKISWVDCQSAAVSNAPSQPPTQEKSPQKARRFSFFDSITRRHSVASSPHSDDQGMFRLTPTHIEQQVEGLLVFAENIGWPRVDSLREIFASKLQHGDSNLDIKEIFNRPARGASVEGHTEETTKDDTFRKLATRRLVVLSGPSSDDTKSAMGGWITRCWLSGFVVPGQAISHLLMATVLENDQEAIARLGLIANLYGGFALNGKSWWSQECIVGRVLSALNETKACMGWISSTNIPKEYQTQEPLDDAWFEVIVSEPPTGLGKPRIKQGNKISVESTPLGLGSLVSGEFTLPVDDVPDAKSPVDVKFNALTFSTMEERRNSNQHAIVARKATMSFSLRTGTSTATADVSFPLTYNVNFVTSHACRLPPGLASYQHNASPDGDGKGDRSRSLSPAEAFSLKYGRLPGHPLPSSYRYKYLALDDLPAPEGSSIAKVFEHAGFDLTVDEVFVVDARQSAEKEALARSWCASVGYDAIIGRTGRTCLGCCIREARALAVKVVIRVGDQEITG

SEQ ID NO: 42414 - protein, 64 aa, A.fumigatus
LVTQVSQGLKAVDHGFKIDISQTNSFPGGRTITKKFFSIMYSAVETLRVGLMVMLQKFVSLNGR

SEQ ID NO: 42415 - protein, 2195 aa, A.fumigatus
CCPSLLSEVSQTAYVLMSLPTNLQAFRFVNSSWQEHEYELCLTLLRLNQAGCITSELSKPGYVTCPTPWKTRIKDILGSRGPSATEVALLNAYSKLPSAISLTTEPSLLPDMTRSLYDHLSRVLKESELDLSTSTKFFLGQGFKSYVDLAASNEGVDSGLWGAIGSAAAKYSRIQPFLGAILTYVSSCSTKLDFGQPALEDFANVLITNLAGPSQQVRLLSLKILRELVQASGEDPAPISLAIEVEESPLNLQTARVLSMHVRKLAILYPQVASQRWMASLIPNFCFGLFSKKLAPLWEDSAAALKSISEHSAGEKIVSDLAFQWLQERGSTDTADKADDEAEYHTSGDFKCFNAANIEDRLASHFNATVPPSSKLMEGFERDHEVSDVVPVAPRTHALRVLNAAPALAEKKSRLIVPLFLAWALRDDEDVESANDLYIPWGFHDRLSFLGLLGKFANPRVLFKASEVHDALLGLLCHGNSEIQKSALKALFTWKSPNIMPYQENLLNILDESRFKDELSVFVHVGGEDSLIEEAHRGELLPVLLRLLYGRMISKASASGQAGQVGRRKAILRTLSQLPDNEFEIFMRVSFGPLGDVSLLQEGQVNQEAFARDLVSPRRQMGLLRMIETVFDTLQSRMALYAQRSMDTVLYCLVRACRELEKDSSNVAADSPEGRLLTVFRNIRHTCIRCLELIFAVSLDKDWSAYIHLIFDEVINPRLQNFAIETAQGVSGLLRLFHTWATAPRSSFYLVRHNNTVLTKVVDCLSVESARDEVKVYVMDEILVPLIRLASGKELEEKEEMSDFSADEIRSEVLSPYIEHTLSHLGRLLKRGPSRTVLVSGVQTISLLAPCVESFQETTELVGITTYLLRQPADRVSPKTKSGLLRILEHFLPLFNPEEDPTLFQEVFEAVSSMFDYFRDDANREVLSGVFAAFVKHDPALDKVAELCADLNSISRKKLEVDYERRLQAFAQINDSLWEILDAKQWRPLLYNMLFHVKDEDELAIRSSASFGLNRFIERATKEDSADADEFEPLVKEILFPALQSGIRQKSELVRTEFVSTLGYFVKMNPTRPNVQDMHGLLVGDDEEASFFTNILHIQQHRRLRALRRLASEAAKGSLQASNISTIFIPLNEHFVFDQEVDEGGHNLIAEAVATIGALAEWLDWNQFRAIFRRYRGYMQSKSEMEKNILRLLGRMADALSNAMRQKTVVQKTGDDSMEEIEIPAPSKCNLARTMPSPAKVATELTTNFIPFLTDFIHHKDEAQMSLRLPAAVTTIKLLKLLPAEDMAIRLPPVLLDVCSILKSRSQDARDTARKTLNEIALLLGPNYFGYILRELRSTLTKGYQLHVLSFTVHSMLVATTDDFQQGDLDYCLADLSAIVMDDTFGVVGQEKDAEDYVSKMKEVKSSKSYDSMELLAKNATVRNLANLLRPLESLLREKLNSSMVKKLDELLRRIGVGLLRNPGAESRDILVFCYEVIKETYRDPAGVEKEPSVSLREQRYLVNLKGANRGDKRGTTSSHIYKLARFSLDVLRSILNKYDSLLTPTNLAGFIPIIGDSLIQAHEEVKIAAVRLLSTIIKLPLADIDNNAHVYFTEAVKIIKEAPSTNTEAAQASLKLVSAMLRERKSAKLRDGHLAYLLQRLVSDIEEPDRQGVTFNFIRAVIARKFVVPEIYELMDHIGAMMVTNQTRSARDLARGTYIHFLIEYPQAKNRWAKQLSFLAKNLDYKHQEGRQSVMEAIHMLLAKTGTELAQDIVGTFFLPVVMVMANDDAPECREMAGALLGELFSRADREQMKSMLTPIRSWLEQTENTLLTSTGLQAMRVFFEVEETIKDKEARFVMEILPEIMQPILQSDETEHWEVLYFALQLLTKLCKAVPAVALAKERGPIWAAVRECLFYPHAWVKTCASNLVGTWFADLARTNAANGYGSIPLVGSTGLALDKDAMLQLIRASLRCLRTPGISEELAMQTVRNIIFLGRCCAQNGLVFPSSGSKDAELSESESEDEDDDEETANGRTERSDRSAIQYIFQQVSSILRRELLTTKAHSLIPKSASIGLLAALCRHLETDQIRPSLPTILLPLQHLTDPSIPAPRSSDERFRESYKALVSNCHEVLDLLQKKLGTSEYITQMASVQDSIKERREGRRMKRRIEAVAEPEKYERDKKRRNDRKREKRKEKGMEQRGKRSSPRGSKDRRY

SEQ ID NO: 42416 - protein, 483 aa, A.fumigatus
QALPKCFLSRNTATILSALLSLSPSILEMVATSSASRTASVKRVKKGTETTKSHRFEPFSQRVAKLKIDPIHRVRRPSFGEEGEGDGDETFSYFRSAFDHWIELNLSDNFSQFARKVNPLCESLAQILYHEDKIMGLLVEYIEKRDQLSIEPLLTLLAQFARDLGVRFEKHFATAVTLVASVAATHPDVEVVEWSFTCLAWIFKFLSRLLVPDLRQLLGIMTPYLGKERQKPFVARFAAESMSFLIRKAGLVYYKNKAPLQHAVSFLLDDLHQAAADSKNVETYKEGLMAMFSDAVKGVKGGLHSNATDILNCLLDNAPTGNELRSRLAVEVVSGILINVNHNTTAETYEPVVETINSYIEANRKKSDKQHANLYCRLMFICVCTRKGSRIKNWKPIHQTLLLLLQNASAAPSAYADSIPQLLTTVAYALQVSPMDEMLPFMRPLMDAVAKEQLSAYFLSFCATFSEWGAERFHSVVLPYFQK

SEQ ID NO: 42417 - protein, 337 aa, A.fumigatus
QRSSVVVGSVNCELREVFTKLAKLHVKQNFSIAIIVGDLFGDCSSEHELDEISALLQGNINVPLPTYFGLGNRPLPTRIVERIEANDEVCPNLYFLGKRGTLKTAEGIRLVALGGNLEADSKATNKFHPGYTESDARALYGAHSADILITHQWPKGIRTGSSAPLPEDAKVPQEVQCIADLCSTLKPRYHLSSSDGFFYEREPFFHMPSEDNPDAKPLTRFISLASYSKTSKQKWMYAFTLDPKAPPPLTIPVGDTATPVAPIQVKRKVLPSQRESYHRFAGIEEDHSRPRKRARAPPPGPEQCLFCLSNPNIATHLITSIGNVLTTEWPNRPLTRG

SEQ ID NO: 42418 - protein, 490 aa, A.fumigatus
IKFQLTMASSSRSLPSSPAGLVESPSKSMSPNNARPAHRARPPKPNYKHIHRFPLPLDVHPLPPLIPHNPLSLISVVLSYLTYFISPPHQETYAAYFDSATSSVHVTDHKAIQALWEMGFFGKGTLSRSQPSWLEREKKRRGLLGGQTNEELTRQRRTERRELKLERARMEKVAIEKRLKAEAAARESGATTVDQTTATLLTDVASGGTAVTLEKFSLRKAREARMLESRRSKEQENKEPASPSSGQESPSKAVRFSPVVQEKEFASDSATLRLPGLATEAQETSQEELPLKNEEHLQLSNEEAFFLAYGLGVLHVYDHQQKTIIPHTSLLSLFCHNSYYPPRDPSTDLKPDDPFMISYIVYHHFRSLGWVVRSGVKFGVDYFLYNRGPVFSHAEFAVVVIPAYEHSYWSETSDRRSYCATKQARSWWWLHCVNRVQAQVKKSLVVCYVEVPPPRSHDSKTHSEDIGALLSRYRVREMLIRRWVPNRTRD

SEQ ID NO: 42419 - protein, 276 aa, A.fumigatus
SWTTMGASLKDGFNELFELPSHPPLTTPTKSAAPGTNCDNGQFRLAPTAEEVGFACLIADKHSRRPKYMQALALNIPCLSDRWIEDCIAQNRILDWEIYLLPSGESIYLNGATKSRFLAPYPATTARLPDTIASRPNLLKDQSVLLVMGRGGRSDEERRKAYIFLTYALGASRVERVSDLKSARASLDQQAAAGTGCAWDWIYVDGDEMASAKATILGSSMPSTLKSQSFKGTKKRKRTELIEFIDGSDLGLSTSVKIVGNEFVCQSLILGRLFGQ

SEQ ID NO: 42420 - protein, 67 aa, A.fumigatus
GLSSFWPPSRRRNSSSSSTCLEVVIKNTINKTHKILPATVQDINSYGKEVSYYRAFCCSIKTRGQHN

SEQ ID NO: 42421 - protein, 1164 aa, A.fumigatus
DLAPSQSLLDELETVDSLPPRVSDDKSRENNQISDFDASSTKPEVVRQSPARSISRTEHAAVPLNDRKQFFGSKDVPESPLPVGQTARMSSADGVPSDTQVVSQSVFDDMIRQNKNAARNASDSNLVERATMMTLHEGDSGHVDLLSGFENTCPDIIDAEDNGEQNSSRLGESSPLHYQPNLFPESQRFLTSTPATAFKLGQPERSNSETPCVPKNPLPSDIQSSGGVMALSQVFKATQAPSSPLVYGQQPDLMSDRPSPNLPIQNHPLAAVLSSPLNALAATFPQDRSETPMAYISMKESQARRDRLLQERMTRSAEHIYAEDQSDSEFEKEPSFVERIIRQRTINQEASAQFAGVAAPARQSSRRRTGEETTSSLSELKQRDQADVLKSPTSRVDPNKIDAVLQSGAISEAETEHSGDLTRSQPTQQVPSLSTDEDKENCNNDSEHCLPITASAHDRLSQALSLHDDSLAQEDIQLSRSPDREANEPKATLETMVVKDSQQSPRQEDRGHHDKIVTNSLRHHSGRPRPRVRYHGDPSDRDRVISSPTRPLALRSSPPPPECVQDPVLHPAHLNRAITRSQSSSPNCHDSSSQLPRDASSAQELATTESSNVASRKPNGTESKGARVDPHEKPSSMPSRVTETPVPQRPRGFGDVIPTISVPETSPNTIHNQSWADDVDNDPMDQEDDDLPPTYPTEQARISHSQPLIPESSTPTRPFRTAKILSSPSGRQRRALTEIAADASPQAGTTLIDVDIGILTADDKEFSSVVSASPIPPRKKRRGNGQNVYASDPILTFTPRITSQYAQSQNGEKPRGQILQTEEFVDKSESSFLKRSRSSKRIGTVWEVEDTPQHHVSRRERLKKLSLPRAEAESGPQPLERAKNMNLHAAEREDPCEGSLKFPQATGEKMKDKSPELLRNDESDPAGPGHRDSSPIALNQVIAPWSGQKRAYYPATCVGKPPGISQTRVLVKFEDSAPLEVPMGAVKRLELKIGDAVKVDMPHVPKVTHIIRGFEDKISAEDLTKAASDGVLPITDVYGYTTLILGPKQRKSLPSGGLTGPDNLIKVPVSRIYLDTILWNQLKDRAFTYSSGATHSESRLQTPSDRYSTPASPGSRLPRSIRLMNGIFAGMVFAVSYGDNDEAKSRITKMILDNDGSIAEGRLQ

SEQ ID NO: 42422 - protein, 84 aa, A.fumigatus
NAKRESLLSLPSYKIPYKCAIGITILTPWTDPKKRETRKPRDCQSNITSLGIERFYLGYSTEELLLLRTSETQATQGLCVIHQK

SEQ ID NO: 42423 - protein, 310 aa, A.fumigatus
LSAKIGGKSRGFPPVMSFRSPRRLGIGVTPLSVQPTMLQPRLLAPFRALERTFVSSLRSSQAIHHPPRSSLFFQRTPISAPSPISKFLLPLSHVRHASHATQGTANRHSRDPAGKRLGAKRTGGEYVVPGCIIFRQRGTKWFPGENCAMGRDHTIYATEAGYVRYYLDPERHPDRKYIGVCFEKDGKLPTPRNAPTKRRLNRIAVPRIPDGPEVVAQSDLLATVEEGTMISSVVAANATTGPPLRPGYMYREANWQIGRAAEKAGITAKPYKRKNRWLAWRKRQARAERAAQMKSLKSKKKAAKKGKGGR

SEQ ID NO: 42424 - protein, 125 aa, A.fumigatus
DCEHCIRTRLVRIAGYVSSYGLNVPLQCPLTCVFSGQTESSYVIFTDDPAKRYEDFTDADFSQKDDNLGIKYENNDIFEDTVLLLRYNCPDRSCDVACLGWPDLHRHVKSKHGKVMWYVLSCCAP

SEQ ID NO: 42425 - protein, 155 aa, A.fumigatus
RFHYVSLGPRKLYQTYRAAARSPEGGEPCHVLSRHGLYCLCGFRQSCEALEWTGRKVSREIGCFTIIQRLTRPSRFITTLRGHVGAVYQCCFSADSRLLVSSSKDTTLKVWNVRTGKLAMDLPGHKDEVFAVDWSPDGQRVGSGGKDKAVRIWTN

SEQ ID NO: 42426 - protein, 553 aa, A.fumigatus
LFSDLCTRNKKVFTHEHELFTMAELRKHEKYGDDVPGALDQSGFKGHPECGFCRKRFYGDDELYAHCRDRHERCHICDRRSGSRQQQYYIDYNALEDHFQKDHFLCLDKECLEKKFVVFESQMDLKAHQLECHPNGLSKDARRDARTVDLSDFDLRAPYQSQRQRRGAGRGRDPNAEPLPVSSTQPLRRDEIAYQRQMAIQSAQSVSTRSFGGQLTRNDTQTVRAPARSGAATPVRTPPAGPPVAEMEALNVGAPSGPATPQDQARRLRHAAVIERASNLLRNDASKLADFRSKVSQYRTSALSPTGLIDAFFSLFDTSSTELGKLIKELAEIYEDESKRNALLKAWNDWRAINEDYPALPGPGGQIPGMSSGTVNGSGVGGKRVLRLKSSTAQSSRSVVGRSGSIVSTSSSSSTNPFPPLSSSTARSAPRATTTSSPWATVAPTPARTMASAINPSSRPAPTPSRTVQNTNDSEAFPALPAAPKPNVLMAGLTRGTVRWDDRQPPPVNAWASSTGSGSASVNGPEDEHGESSSAGGKKGKGKKGKQTLFHFG

SEQ ID NO: 42427 - protein, 360 aa, A.fumigatus
DDDERVPYRFTYQSDDKDGQTIDIQADLYHSLLKPGLKTTEDTIHLYFTPQAVFRVKAVSRCSASIAGHGEAILATSFSPVSSSTMVSGSGDSTARIWDCDTRTPKHTLKGHTSWVLAVFYSPNGAMIATGSMDNTVRLWDAAKGTALGGPLKGHAKWITSLAWEPYHTQEIGRPRLASASKDSTVRIWDVVGKRIDTVLTGHKGSVTCVRWGGTGKIYTSSHDRTIKIWNAQNGSLLQTLSAHAHRVNHLALSTDFALRTAYHDHTGKVPGSDTEKVAVAKKRFEQAAMVNNKIVEKLVSASDDFTMYLWDPENSTKPIARLLGHQKEVNHVTFSPDMAYIASAGFDNHVKLWNGRDGK

SEQ ID NO: 42428 - protein, 103 aa, A.fumigatus
  UNSURE (15),(88): Identity of amino acid sequences at the above locations are unknown.
RYENNWIAAPPFIPXQNPYQKDQVYWYAAGCDDMNGITVATNGTHAVTLTPGTVAFCNAANTLHLLIGTGQATKSRAPMPLKCQAPPXWEKGPVDAPGGIEGE

SEQ ID NO: 42429 - protein, 81 aa, A.fumigatus
RLCFFCALNVAHSSVSPCNHRTCHICALRLRALYKNKACAHCRVRFVIWAECSTPVSTNVCVFWPDRVQLCNFHGRSGKTI

SEQ ID NO: 42430 - protein, 79 aa, A.fumigatus
RLSVPLLYIADTRQWLTSQLILAPTKRTFQYVEQSGNNVIMLKTYVSSINSIYKALATAQSSLLMTIREVYPGPIYTVC

SEQ ID NO: 42431 - protein, 179 aa, A.fumigatus
LFEVHNPPFSSSTSCARISDDSLLLVVNSARMMRSLSCVSSFGDASSFTALTSRQDSDRPRTARPATTATSIASQDIICAISESRGVSSTVGLAFVNLSTAETVLCQICDSQTYAKTVTKIAVFEPTEILFMSSARESKLFYIIQENIPDTAYTFFDRRYWSEKAGHEHVDRLAVSARC

SEQ ID NO: 42432 - protein, 125 aa, A.fumigatus
FQKVLKYIELELNRVFTSHSLRIRFEPSQGSMSMDLSTIVSLELIQNLQNAKSEDSLLGLLNETLTPMGARLLRANILQPCTEKSKLLARYDAVEDLSTKEDMFISVRQGPFQFDLICSKKTLIS

SEQ ID NO: 42433 - protein, 468 aa, A.fumigatus
RSKCRCRGPSWPKYQVHYNGSIFFWSILITCPYAESHNLTLDLKFDSARQYYISVSASEVKTLSGIFINIYRRKNRIECQTLDLVKLNQKIMDAHNEVINMSDQTIQSLINDVCSEISVLFKVSEAIAMLDMLAAFAELATCNEYIRPELTDVLAIKSGRHPIREKIHTKKFIPNDAYATQQSRFQIITGSNMSGKSTYIRSLALMTIMAQIGCFVPAEYASFPVMHQLFARVSTSDDLEANVSTFAAEMREMAFILRNIEPRSIVIVDELGRGTSTTDGLAIAIAIAEALIESHALVWFVTHFRDLALILAERNGVVSLHLAAEISPDISQMVMLYKIAEGPVTTQFYGLAVAKLVDLPPGVLERAQTVSEKLNRIAQRRHSRSKALMLSRKRNLLLSLREQLLQARNGTLEGDALREWLKELQDNFVLRMAAIEDETAEMNNEEVDYDSNTAPAESAQDNFGQLSS

SEQ ID NO: 42434 - protein, 1022 aa, A.fumigatus
  UNSURE (80),(384),(390),(398): Identity of amino acid sequences at the above locations are unknown.
LWKSGSCKRPDCRSTFPSGECPESNDPKTRQLTAVQEKSECLTRDSFLVRRHEGLRRNRKALLSDLTALVRTTKSFQVIXSGNPLQDEVEYMVDEMLLKAFRVVTRGVRFLDIWNEEVGLSRTIAELAQSKDHTSPLTRASETFVMSEKAPSEAETERNESRVLNRSRMSMSCCSTRVDMSEQPRPVSVATKRISISHRVSYSGPAAASRNPNLASERLNATYDAFLGVLGSFIGLHLQSRSSTELVVTTEQAVRSCRGLLTVVEAVCEHNSQGCSLLESAKDAMYERLSELVFAAREPFRPAQSPDDELVFMPDEGKATGRRRHRLRPSGRELSGQSSPGCGSQVGDFELEALPQDVATPLVGAGPESQSQQQKGDQPELSMXLPPHPXQIPQNADXESSHPTPGLTDDTTPSSSFNSRNLSNPTIAATDEASLPSANIPPPSPAKSSFSSSCDAAAGVKVLENRISHPKSEIGESFGRGVTSTGSSFTYHSHLRDSEMSGVSQTSTRATSPDIGSCYQAPSLKSCVSHSTLAEEGEETEVNILEKTYAHELIFKDGQVMGGSLRALIERLTSHGSTPDAMFVSTFYLTFRLFATPLEFAEALVERFNYIGDTPHAAGPVRLRVYNVFKGWLESHWRHDCDDSALDFIVNFAKTTLMQSLPSAGKRLLELTDKVSTLQGPVVPRLISSIGKTNTATAQYVHPDTPLPPPILSKKEVNLLKQWKNGEAAISILDFDPLELARQLTIKESRIFCAILPEELLATEWMKKSASLAVNVRAMSTLSTDLAHLVADSILQLEEPKKRAAIIKQWVKIANKCLELNNYDTLMAIICSLNSSMISRLKRTWEVVSQKTKATLETLRGIVDVSRNYAVLRQRLQTHVPPCLPFVGTYLTDLTFVDHGNQPLRSLPTDDGEMTVINFDKHMKTAKIISELQRFQVPYRLTEVPELQTWMQNELVRVRSNGEKSLQTFYRRSLILEPREITPRPNLQPESSASSIMENARDKFDLFAWTHPSKAKSVATNS

SEQ ID NO: 42435 - protein, 217 aa, A.fumigatus
PSRRLIAIGTRKRTNRSLENRDMEPMKRHIAPLKVEKTITNPCGSTTSESGDPSSNHHYSTQHSLQLSPPLTPYCATSSKDNSMDRTEAPRAVFHNYLRAFYPFHPPGDVSPDTITLPLDQGDIILVHSVHTNGWADGTLLDTGARGWLPTNYCEAYDQLPMRPLLKALTDFWDIIRGGCGSSLRDFGNQDLVRGLIAGVRFLLVSVLSRMIQRQGN

SEQ ID NO: 42436 - protein, 78 aa, A.fumigatus
AQRRQYSKLKGATSKESTQDQVYVHLRRLMDVIMSAFQVASAQNKSINLSNATPGQFSLPTSTPFSPQLSRCVHGSCC

SEQ ID NO: 42437 - protein, 77 aa, A.fumigatus
RKSVQTHILWYVDDISFNIVTLSTLLSYWRSVSILFLQSLTTMAYQVLINALKAPAHLQYQLAFLSSVSVRAKDAVV

SEQ ID NO: 42438 - protein, 75 aa, A.fumigatus
KCNICLKTYRYGISVEEGFIYMSLDYIEEHSYQEMVALAVVFKRLPSLGAVMPGQSSLSDVLLLPRGFPNDLGTP

SEQ ID NO: 42439 - protein, 457 aa, A.fumigatus
  UNSURE (389): Identity of amino acid sequences at the above locations are unknown.
YKEDQFIAEMARPKAIRAPTAASLPNTLRLPSSTSSLIKSFSRLSRHALLDLVFQWLDDRNAQLFPPYLQKDEIENPADDKLSPYPAAETIEDVRNAYQDLQDRKGGKREVIDRILEGDWRHGITLRQLAMVDIRYMEDHPASLRWTAFELSRIGMDGTQSAGATTPDVSACLPRIHATTFLSNLQQQISPLVKAHYHLVRSSSLPLSFLRILVTSSPYQNPRQPPEALMDSSRVMYVAFPDSCPFIYTSIATSPVAKSNTTTNHAVATDARSLQRIVRDALPKALSRPQERYALKATSLTAKNLQALLALRGPGRSNVAHGAFSIFADAVLEGSPLDPRPSDTISPREHFYQDLDKENENQEDGNTSKETEPSSHVAKKRKLTVHSRXGTTGTLSAAPLEPLDVRLLEPTTMRMTNMRWTTRNHQYHSHLSARTSSVVSASSPNWVSLTRSVCRPG

SEQ ID NO: 42440 - protein, 70 aa, A.fumigatus
THDDEDDEHEVDHTQPSVSLTFVGSDVISGIRKLAELGVVDPERMPSWMTGEEAVSVAVVHRGKRVVKAG

SEQ ID NO: 42441 - protein, 112 aa, A.fumigatus
LTRSRPTYLQKDNEIMPRGAEYDNGIPQSDNAIEAGETKVHGTNSAVCPANHLQHPKHDVLILSMILTNNRTTTSIASTAQLISPMSLPAACTAAAVPPATRAARAVMSLVP

SEQ ID NO: 42442 - protein, 162 aa, A.fumigatus
NRTYFSQKPRYQVTEDNGLIGLRIRRGRRNTGDIPEVALPLIQVLVSSSCIDEENPRGTLNQPATIHHANATLLHGVHSLHHAGVRGSQLLHLHGCGGPVQRPDQGVPIAIFSCSDRSFRFQHGVYTTDSVGDFSSNLKEDVVAHISLGRVGTSILAVHRVP

SEQ ID NO: 42443 - protein, 63 aa, A.fumigatus
DGGRFDFSPFLHRAPSCMQHMIYLDSESSNACSATHQLLFSICIKNSCLMCLRYLLCTCQLVG

SEQ ID NO: 42444 - protein, 178 aa, A.fumigatus
QGSDMREPNKEDESITFLTAVPKSGFETIISIPAQTSQNYLRVLGLNATGQILGATAWLHWDPESEEVALGPGNRDSGNGSSSSSSSSIDVRAFLFFAFGFSSAVFLAVCAWFVWRRFWTQEADREWERERERGGWKPVDEFNGDEHDLSEGEFEGMELSLLQGRRLSRSDSGGEFDG

SEQ ID NO: 42445 - protein, 77 aa, A.fumigatus
GTDEEPGWALEYKHPSALFHHIYLFYNQNSIYDQVYEKKSCCAVYLKGESQSSLPLHFLPYTDGPRQSVPSARLALS

SEQ ID NO: 42446 - protein, 67 aa, A.fumigatus
ARCIDIEYDTDEQQNDHLDRVNRTADLPDVPAGGMHSGGGAPGHSSGKGGHEPRTLGENKGLGAHKA

SEQ ID NO: 42447 - protein, 339 aa, A.fumigatus
  UNSURE (260),(278): Identity of amino acid sequences at the above locations are unknown.
YDYLNGEKMSLMKAIILHTPGPPDTLKLTHHPIPIPEPGELRLRIKAFGLNRSDLLVRQGRANHPIAYPRIPGIEAVGIIDTAPGLEDTFPPGSTVATAMGGMGTVFDGGYAEYVCVPARQTQLLQPKTTLPWEILGAIPVMVPTAWGALIRSLGLRARDRLLIRGGTTSVGLAAAAIAKAHGAYVASTTKKKEREAMLLENGADRVWTDDGAVAEQIRDADSGCYYDKVLELVGTATLADSLRCVKKGGVVSLVGRLCXNGDLEKVDLMELIPSGVXLTVYHGTSEDFMNTPLDAVLRLIEQGSLKFKIGRVLRMEQIVEAHRCMEENEAEGKIVILP

SEQ ID NO: 42448 - protein, 86 aa, A.fumigatus
EEVRQLMPPALFHFLLTPGIAYPSSFDGPEDYFDVIGGTEQKLSRPLSVPGSPRDRSGVMTPGDFATIQEVKEGLDTEDYIAWRLP

SEQ ID NO: 42449 - protein, 75 aa, A.fumigatus
GQLAKWSVLCRHATPYHAPLYLAHSKGFFKEEGLKVAILEPNDPSDVTEIIGSGKVDMGFKAMIHTLAVCSWSCR

SEQ ID NO: 42450 - protein, 89 aa, A.fumigatus
WFDAHSHQAKARNFPVTSIGSLLDEPFTGVVYLKDSGITEDFRSLKGKRIGYVGEFGKVCGVFSFSGRRACTHWGVHRSKSMSSPSTTA

SEQ ID NO: 42451 - protein, 411 aa, A.fumigatus
TYPSFLDRLSTLVSHKSTKELKFRSEQTSQLPKGEFLRYFTLNRLFADECEAISGRSGTAMKTVVSNQIRDYINRFGENQRHRLVDVMDSDRWDARDFGETETAILSKILEASTKDVEAWLAASRIWSPQEEQTEKARRDSAATNGTGKDRVRSAVIDEQKYILPECAVAMMKSIEEFQFLMANIPSMIQDIAPGLLESLKLFNSRSSQLILGAGATRSAGLKNITTKHLALSSQALSFIIALVPYIREFVRRHAPSSPLMGEFDKVKRLYQEHQSGIHEKLVDIMSGRSSVHVNAMKKIDWDAAAGNNVNPYMETLTKETGTLHRVLSKHLPETTVMMIMDPVFRNYRDQWTRAFEEATVHTEAGKQRYGSLPTSSLNCTNHPQDATGCGTFPEQAEQDRRLRRLGTASA

SEQ ID NO: 42452 - protein, 185 aa, A.fumigatus
SLRYCILLQLLIYNSRHTMDSEDTGPDPPKRDVRNHILFEIATEVANRVGGIYSVLKSKAPVTTAEYGDRYTLIGPLNRASAAVEVEELTPSNPRMVETMNSMKERGIGMVYGRWLIEGAPRVLLIDTGTGYKYLDEWKGDLWNIAGIPSPASDTETNEAIVFGYLVAWFLGEVRSISGTLRVQK

SEQ ID NO: 42453 - protein, 515 aa, A.fumigatus
FIAHERRRAVVAHFHEWLAGVALPLTKKRHMDLTTIFTTHATLLGRYLCAGSVDFYNNLQHFDVDAEAGKRGIYHRYCIERAAAHSADVFTTVSHITAFESEHLLKRKPDGVLPNGLNVKKFAAVHEFQNLHSQSKEKINDFVRGHFYGHNDFDLDNTLYVFTAGRYEFRNKGVDMFIEGLARLNHRLKASGSKTTVVAFIIMPAQTSSLTVEALKGQAVVKSLRDTIEMIEKSIGKRMYERCLAWKEGDNMPDEKDLITSQDRVLLRRRLFAMKRHGLPPIVTHNMVNDHEDPILNQIRRVELFNYPTDRVKVIFHPEFLNSSNPVLPLDYDDFVRGTHLGVFPSYYEPWGYTPAECTVMGVPSITTNLSGFGCYMEELIENSSDYGIYIVDRRMKGVDESVNQLTDFMFNFTQKSRRQRINQRNRTERLSDLLDWKRMGLEYVKARQLALRRGEATHAPSPFSLLADSRYSLPFILRWSRRLFRRHWRNRAEALASIVSPRVSTGSIWSDDSG

SEQ ID NO: 42454 - protein, 223 aa, A.fumigatus
IQIDELTKYYGMTADDYTAVRCGMNVTKAIIRGDIDAGIGLENVQMVELAEWLASQNRPRDDVQMLRIDQLAELGCCCFCSILYIANDAFLAANPDKVQKFMRAVKRATDYVLAEPAKAYEEYIDVKPIMGTPVNRKIFERSFAYFSRDLKNVQRDWAKVTNYGKRLGILDANFEPNYTNKYLSWDLDADSTDPLGDQKRMAELQKQVAAEGGFKRLHVSAAA

SEQ ID NO: 42455 - protein, 214 aa, A.fumigatus
YLSDHRNCDPTLTPQTGPYTRARASHSSATMRNLSDSVSTYFFIHPTHDNRSNSVAGRSKCHANFKMKRQPRKLKWTKTHRAARGKEMIVDSSLVLSQFAKKRNIPVKYDRNLVAATIKAMERVEEIRARRERAFTKRRLGGKLARERKREEDRMVVAEGRAPHPQGNCGREKRGQPLDVSKISSRVVGEEKLRQKKKTRLLVDGGVEEEMDLD

SEQ ID NO: 42456 - protein, 73 aa, A.fumigatus
ACDMCRKKKIKCDGKMPKCSHCTNYKTDCVFTQVEKKRNPPKGYAYFSALPLGAHADFPSRLVPSISRASKTD

SEQ ID NO: 42457 - protein, 201 aa, A.fumigatus
TQVSCNCANLPHSICLRSGRPPVQDDDDMNVELPSDDPPDNIGNVPLSDGRSKFNLFRSMCRFATIESKVYKRLYSAKASKQSDGELLNTIGELDKELEDWKDSIPLDFRPEHEIKASHTPLILHVVVLHFAYYNCLTTIHRMSVHHGYWTSRLSNYAIQGLNARPLNPRVFLSAVLCVTAARASINLIKYIPQGDFACVW

SEQ ID NO: 42458 - protein, 278 aa, A.fumigatus
SNSLTSPSGSSTSSMATLLRRPGNLARYSRRAAECINRTRPLSARAPQSRLSSLITAHRVRTYATGTPGGPNPPNDKRSQNKAATGPGNDGGKSGDGKTPNDPESSLSKEEQEQVNLFVDHLKNKVPPSQHQMLDDIRTLLLREGLPAEMRQFIEKHVQSGRPASLMDYVKLTRYMSQHMTDYAYKLNQIEEERNKEKAKSEGGAQGEQQKQQQQQEQQREQKKGRDQANKQIPPNFRTFEIKFDPASFLITSLITYYVYRSFFPWGKLPRRSHGQSL

SEQ ID NO: 42459 - protein, 138 aa, A.fumigatus
YLAGAFYGFKTIIIPHNLEPQVLSDHLEKSQAYALIGGSRVPWNCSLGAKNNKQFSQVIWVAKVGSQHMDWNQVPGDFQGNWEVAVWHELVEEKKDLTGLDVPKWDPNSPAPSVTLVWPTKSHVGDFIEFQPEVRCLI

SEQ ID NO: 42460 - protein, 147 aa, A.fumigatus
RRAGLLPVQGVKAITYIATCPDKQVVLTLLCSLLNTVCTVVYGSNYCLVLTTVSRSLSSTILRHGGFHMTMWSGKIPSRSSLYTVYNFFLVFYYILSQRDGRGTPPKNYYRHYFGRLHRPQDFQFLVDGMTRILNQPVGLPSSAGYA

SEQ ID NO: 42461 - protein, 206 aa, A.fumigatus
RPPPTSKLASLRLAYGELMIMISGVFDTSVSQTLYLFIDAKTDGHETFKAVIDALEPLRKHGYLTTLKNNRTITNGPITVIGTGNTPYDMVAPVANRDYFFDAHLESLNEPENAGITDLISPIASTSFARAIGTVSEGDSEAILTEKQLSTLRSQIATAKERGIGARYWETPSYPIRTRNSVWRTLLKEGVALLNADDLEAAAGYF

SEQ ID NO: 42462 - protein, 253 aa, A.fumigatus
FWELPESTEDVFSLFTPADIRRTRDHALPNFETLLLSITSRLTFLKNHPSFPDPDLAPERDVLNCIRILTRILPFIYEAEHLEEWEDKFFWGRRKKNTRGARPGAEVLFDESQAEGRQEETLPGTNDYEDVKPLAEELIDNLLDLLFYTDFTIPKLATTKGKVSYSIWQSGVGCNTSMGSSKELESNRCEILRLLLTLTGKAMYMPLSKILVLVMGRNADDAQASYLFRESRPLPILQPALTNKLSSHCYAHC

SEQ ID NO: 42463 - protein, 495 aa, A.fumigatus
  UNSURE (465): Identity of amino acid sequences at the above locations are unknown.
ELLTAQMSKVDVDLGDSLAKVLPTGVKVTIRHISSAPSPCVALFAAPPGEEPESTFCENHFLAVSISPNENEESEVIIFGIEVLVYGTAHLTTIFVSKADSTGYLHLLKNAPKVSLLRLISNAFLSFLVQTHQRPGVRLMVSLFARAQNQYLFPGSIENPEKHVLDDRGLIKWWCRVIDPILREYEPETGSHEKAVDDQTQESAKSSATAFLIVPGCDKFETRGFFPITARSDGKDRPRWLNSYPLHQLCDNPNAPPRCLVPRFPDDPKTRFLIDLDDELPESTGAAGSKENSGHWRSVKSLAQFWEMMSFRQECSAGRLVGFLWLVINPPGLVNSVQMTSSRVASRDVENVLSESAKTTHDATKQKDEAASVSSPPHPSTSGLQTSPIALPGVSSSDTHATVQQATGPSAFFWPDTGRGHAVLSEEDYKAAINFLIDQDFNTKHKAIASTKAWAEKVASLADQXWVGQRVEGRNATTEPGQKHTDATTVINTAF

SEQ ID NO: 42464 - protein, 63 aa, A.fumigatus
SYNTINPRRCRFAMGASESKLVFKQGIFRLSDEKAIPADDPYWSRICLSYHNFSSDHSSLSTH

SEQ ID NO: 42465 - protein, 266 aa, A.fumigatus
QTSCPHIAMLIAKYCMYSGVWFQLLPRPNHSLTQSIKYNPASWRVPYDHVVWKDSKQIFVIYCLQFLLGLLLYPIPEGRSWDTAQELLSPLLWSAAPTTRLPIPCRWHDQNLEPTCGSAFFSRLCLALMKWQMQVTNSYLPGSQKSIKWAPEMLILFWEALQCNKRFRSFIIDSSRSHDFAILCIFYAIEYKTDASKQGVVRMCIFILQTMSVEPNFGKSLNMKFEAQETLPQNIRIPGFRGTYGDYLVMVCLSPNSTCETVLNVS

SEQ ID NO: 42466 - protein, 105 aa, A.fumigatus
SIHTLLTASKGKLNAVYPALLAIINNVAPYLEHLSPATCSRLLQLFSSMSAPSFLLANETNHALLASVLESINSILEHQFTSKCLYAFTFVAAQLADLLLQKTRF

SEQ ID NO: 42467 - protein, 258 aa, A.fumigatus
MTFPPPPPSSQSSIASGTDKLSSNRAARSQQSAWGLSASQSSIRRGLTPLATNNLSSSSIPSANSRGPVQSTSPAPGGSTSSPLTSSFSAVLSSARGLPGGRSVPSPASTPSPFTTFQSGSQQHQQSGQSLSSPKFRAHTPSSHLASAAGSIAGGGGSGGGGGGTGSSRGATFSPLLSGNTVNSPTGFPSDKPGSAASGAAAHAGQSSLTKISIAQVFLLLDSITEKEGREKWETKAAQIHKVGQSIAFMTFCKSDME

SEQ ID NO: 42468 - protein, 80 aa, A.fumigatus
  UNSURE (26),(45),(52): Identity of amino acid sequences at the above locations are unknown.
CRLSSLTSEEQLKPANISYVAKDLYXGVLRILLILHHDFPKYVAXNHFQFCXVIPAHCAQLRNLVLSAYPSSFPSFQNLL

SEQ ID NO: 42469 - protein, 109 aa, A.fumigatus
LVESNGMEVFSKYFRRLLTGNAAQIFPGVNKSVENAGNYPLLVQEMQKVTQDIEQAQKIAETVDTSEGDIFRDFDLSTFLDHFKLDPVAKVALALAFKTANKSDLRAKG

SEQ ID NO: 42470 - protein, 1639 aa, A.fumigatus
CSPRNVIDQRSLTLLPLLADAILSNSVTPFLQSLATPSEASKDYKNSFIGMTIERFILYPPRNFTDDVKAKLVYAANLRYQKLGVEMPFEVASALQMFNFLNPRYTLVRQLHSRGPRATSNVDAVNEAVNSAGPDAWNEEHIASALLFLVLSQYWQDFSLETFLRAVKSHYVDRQINWSFIFRNFDREGLRLDPKQFAKLYSVLLSAAADDSTLDIQKLWGGDWEHRDTQMSFLTALIVSRTDVSQIPNLRATFPADFFADGPELVRLQGERATKSPLRSLDAMKAIFDIALFSQAAWAAAESQLLIKAVVQYDLPVFLCSALALPQPWTSVQQSFVLRTLVVFILKQEEGYQLALHGAWRQDRQWVAEQLFTTFTQDPTSTAAIYEHAVEFDWLDYLLGYTNGLAMDLACYAHRKGPFDLEQWVRNAAQKGPMDMGNLLSKYLRIKAEDELHVQRKEQPAPQMVSLSVKTVYTLLSVLEEYVGDRENLTPVQRICIQTYPRLINYGEGFDDIIDANGENGNALPETIDKQMQELFGKMYHEELSLREILELMRRYKTSRDPAEQDLFACMVHGLIDEYHCYHEYPLEALTKTAVMFGGIINFRLVDGITLKVGLGMILEAVREHDIHDPMYKFGVEAIEQLISRLPEWAGFCHLLLQIPTLQGTPIFQKAEEVLREQGSQVRDSDPGRLENATGASITNGTLNESAPDGPTRKFLSIHVDPPLRPEIYHDPDEEVQDKILFVLNNVSEQNIEEKLHDLTDVLRDQHHQWFASYLVEERAKLQPNFQQLYLDLLDRINDKILWAEVLRETYSSVCKLLNAEGTINSSTDRGHLKNLGSWLGSLTIAKDKPIKHKDIYFKGLLLEGYDSQRLTIVIPFTCKVLVQATKSTVFKPPNPWLMDILALLLELYHFAELKLNLKFEIEVLCKDLELDHKTIEPSVVIRDRSAHIEDALSTANIPEGLEAFEDMALTTINQGMRTERLSPAAIMSTLPSLDKILVLPSSASSMIDPNVLRQIVHTAVERAIAEIITPVVERSVTIASISTVQLVSKDFAMEPDEEKVRHAAANMVRQLAGSLALVTCKEPLKVSMTNYIRMIQQEYSEQPMPEGLILMCVNDNLDAACGIVEKAAEEKSLPEIEKVIEPQLEARRRHRAARPNEPFIDPSMNRWGLFIPEPYRQAPGGLNKEQLAIYEEFARQARGPAATHVQNVSTDSGRQLADVLQDSYAQIPNLFTPAEQPAVPHRTPQAQQDTRLQQTGLVGAQPQLNGFLEAPTPRDKVDSIVSDLQQAARNAPEERVKDLGRDSAVLQEYNQALRTILTSPSGEELARLTSLKICTTLYSQTPSNLEIEVLVHLLAKLCDMSSLVARYTWVVLSEVDDEHIFNVPVTVALIDAGLLDIRRVDMSLTRLICQKNTGALEILVNLMDRVLFNEEPSALRSDFSGSLEAMSQWLAEDANLAPANEIIRKLRESGIPEVVNPLLSDKARAKRDQMEYIFSEWIGIYKAPGATDRTYYSFLKDLHQRQVMDNQEDSALFFRLSIDISVAMFEHESQNPNGSLDEAFLYIDALAKLVILLVKFQGESTGSSKASKSVYFNSILSMLVLVLNHHHVIRGEAFNQRVFFRLFSRYPLRVFPERTSAE

SEQ ID NO: 42471 - protein, 82 aa, A.fumigatus
TRDRYEQDCLRIKGYLAQGHMVMGQEERKNKAKLEKTQIQLATSSSEYEAAVKILEETTGRWNKEWKAACDARPALNMIMGR

SEQ ID NO: 42472 - protein, 97 aa, A.fumigatus
LTLAGSLAGTDVQFYILVSSGVPQHSSLSLVDKELTFILFVARALYSYTAAIPEELGFSKGDVLSVIRLQDDGWWEAEITTTRSRTGLVPSNYLQII

SEQ ID NO: 42473 - protein, 61 aa, A.fumigatus
CGRLFVEQHSVHQIDQYFESTRVLLADKSSETHINAANVQQSSVYECHCDWDIEYMLVIYF

SEQ ID NO: 42474 - protein, 120 aa, A.fumigatus
RSSADATLSVRLLTNRTVRAAIEDEYSRKLMALCRKPLGTHETGSLRSSFDVVRGETESIAKSHAAIATQMKRELEEPLIAFAGGSKERRKIIQTGIERLLKTKIQQTQTVNKVRQRSDF

SEQ ID NO: 42475 - protein, 645 aa, A.fumigatus
HCDQSCEKIRLALENCEVEKDIVSFIKERGTGQDIPDPPKFINFARGDVNDTSSELSEEDGFSVAQFQRTINPAFRSSSPQPSTYESHHEPRGESAARPDNNSPTTPASREATVTPQKPTQPPAPLDLRRGGHLPPNYDPNQHGEIAPVPHNAYPTDGMTMFCRTGPPSERSSGTNSAYRPSSRESQSEISNPTSVSSQEPPSARQSPTKPTNGVALPGLGGDKQIQKRRSAFFSNSPFRRKSRHDKDRNSGPSHTPTRSTWESPTKQATPVKAPQPQPPQPPAPVLDNERQVESPEPADPRANFQLNVGNNVFDVASPDKATAKKAAQTAKAGEEELDPIARALADLKGGGKQSMTRVSADRYHGIATPVPSAPPSNYSDAPVATPPPAYNDPSVKRLDAPQPAFTSAQMQKTTQKYTGQTKSMLRGSGNTPSLASRNSAEVPRAKQEIPRPKQETPRAKSPVPRRSASPQVPSPQVISPQPISPQVSPARVETRTGHYSRGASPSPSTYQANSVRSRYSQSPSVSTPPQRPVDAAPSPREFPRRSSPNPAAARAVSPQPQFRQQTRPSSAGGMELQLSSGGSGDMYGTSYDSYSARGRDSGRPMSYYGDGGSQGGRSRSRTVAVADPSRQFSRDGRPILHFGK

SEQ ID NO: 42476 - protein, 130 aa, A.fumigatus
RDISCRPLVATVEVLCGLEPRHSVMSDRHERLTETMRRSLQATIRIFVVVVIVAMAIVFPSFDKIMALMGSALCFTICIILPLAFYLKIFGKEIGMGERILDWFLLVTSSVMAVIGTAWAFLPQDMIFAN

SEQ ID NO: 42477 - protein, 153 aa, A.fumigatus
IAPAFTTAGIYGVLGLMIPIIGQDKSPLQPNLYLIIFMMVDFFSLLLQAVGGGLAGAAFSQNSSPWPGTYTMVAGIIWQLVSTCVFATLVEYVPWPRTDCAESSPAADLAVVDDCGYVYGGAGRVSEHGVDEWVARVSVYAHLTTGLESTASL

SEQ ID NO: 42478 - protein, 301 aa, A.fumigatus
RTTVDPSSPVVKTSSAELSPRLSFADAFAAVQQGEADYAIIPVENSTNGSVVQNLDLLGDRYGLYEDVNVCGEHYLTVHHCLLVRKGLSQPDIRSITKLYTHPQAWGQCENFLGKFLKGVERQDVSSTSKAAEMVSLETQERSGAIASRFAADYHGLHVLSENIEDRADNTTRFLVLRNTKSERTASLPFDAVKAPAVSLKPPPTPSAEKTLISFRIRQDFPGALADALLIFKEFGMNLTSINTRPSQRRAWQYIFFVECQQFPTDQNNQGVTKILDKMQQVTEGCRHLGTWKDQLSTSKV

SEQ ID NO: 42479 - protein, 394 aa, A.fumigatus
ITTCPAMTSSHMKGGFLIPMPTAKPAHQATMDVRSMITICRDKGETYQDHLAHKAFSQLTSLSRSSSFSARFRFAGGPNSIDHFARSWQRAACFPEVLPRRSSFAAVRPDEEWTSGWNEDLASRSSLSARQETDYTRPLLHGDEEEDGGNTGHSKKAFPSTTILSSSLDRSLGTSYGTISSRVSEATRRHALQLHREQLAHRNAAVVPDGEPLLVKQIQRDDGTRDSVIVGQSTVPQTVFNSVNVLIGVGLLSLPLAMKYAGWLLGLFFLLFAAVTTSYTAKILAKCLDVDRNLVTYADVAYISFGHHARIVTSLLFCLELIGACVALVVLFADSLNALIPGLSILQWKIICGFMLMPLNFVPLRLLSVTSVLGILSCTSSVLFLSLNDARRMY

SEQ ID NO: 42480 - protein, 63 aa, A.fumigatus
CVSLPLPLSMCQLDLFLNSAPWGAHSCFPCIYRDMRHPHKYGKSLWATYIFTVCIAARLRVED

SEQ ID NO: 42481 - protein, 60 aa, A.fumigatus
HNQQYSLDCAMAIVGWLMFGDGVLDEITANVLLTTEYPQALSICVIVLIAIIPITKVPLK

SEQ ID NO: 42482 - protein, 98 aa, A.fumigatus
KALQGFVRPELTSYTLSRTSSTIPYYRTVRCRYRYTAKDFHLGQLGRLFYVVADYSTFPEDTMMVGINQTRISWTGYEIGFGNQLHITNKSETVAKKG

SEQ ID NO: 42483 - protein, 156 aa, A.fumigatus
DATMEKTPDCLPYSLNIPTPFGYRPSLVAGIIFMILFLGVTIVHVWQAFRHRNIWLGLAFSLGTFGELVGWLGRTVAYRCLYSVKLLEMQLAALIMGKSSFFFFFFHCQETIYNYMNSPRLHDSRHLRCPGPDDPNHRTGQVPLAAEPLPHHLYDG

SEQ ID NO: 42484 - protein, 297 aa, A.fumigatus
ATAIDSVFQSTMAAVKKRLKRPKLLSHTRPPTARAQNPKLSAKATRNLIRTHHRLLKSRAQALKAGNEDLVREIDERIEANGGLESYQLASKLGQSLERGGDSSKVLVDWIAPSLTQLKNSPYKLRMLEVGALSTENACSKNQYLDVTRIDLNAQEPGILKQDFMKRPLPLTDGDRFHIISLSLVLNYVPNATGRGDMLKRCVGFLTQTPPAGSSITIRPSLFLVLPLACVKNSRYLTPSRLQDILSSMGFTLAKSKETSKLIFQLWEHDRQGEPRPFKKEILNPGKMRNNFAINVQ

SEQ ID NO: 42485 - protein, 74 aa, A.fumigatus
AQEPPSVFHCQRQRQQADSNQDIDRIENSLRHSRLAYNDTVSRSIIALNLFDKERLTIGNYSCVAMCQLFPMEL

SEQ ID NO: 42486 - protein, 90 aa, A.fumigatus
STLTSRWALAVPPGLGLCHPGKTGGTDPYYYYSFALLLSVPCHPTEPDEICSNTPLDLDGKLTSFKVCDWIPSLSLFSFCFFLITTLSLK

SEQ ID NO: 42487 - protein, 96 aa, A.fumigatus
SLPASDCQVLNPILPLVANHRRVANMSAPQPNEAEKNIEIWKVKKLIKRLEAARGNGTSMISLIIREALRIRPFARWFANVIPQPPKIKSHERQRC

SEQ ID NO: 42488 - protein, 81 aa, A.fumigatus
GTASNIKSRVNRLSVLSAITSTQQRLKLYNKVPPNGLVIYCGEIITSEGKERKINIDFEPFKPINTSLYLCDNQVPYRSFE

SEQ ID NO: 42489 - protein, 369 aa, A.fumigatus
STVVKSSRQKAKNERSTLISSHSNPSIPRSIFVTTKFHTEALSELLESDQKFGFIVMDETAAFFGTLSGNTREVIQKLSVDLPKKHGRGGQSALRFARLREEKRHNYVRKIAELAVQNFITNDKVNVAGLILAGSADFKNDLNQSDMFDQRLQAKVIKVVDVSYGGENGFNQAIELSSETLSNVKFVQEKKLIGQYFQEISQDTGKVCYGIDDTLKALELGAAETLIVYENLDVTRYVLKASTGSEVIVHATKAQEENRALFTDKDTGTEMEVVEQTSFLEWLAENYKDFGATLEFVSDKSSEGNQFVKGFGGIGALLRYKVNFEQLADLDDEDEFYDGTSRILKYLVMYANAGHLCRLTVLRPRRERG

SEQ ID NO: 42490 - protein, 230 aa, A.fumigatus
APHHLVYQGHTCITISQYIVSPMYLGDFNDPLGRQPKDGYQYASITAALVAPVSRGNVTIQSADSRDPPVINTNTLGSATDQQVAIAAFKRLREIFEAPELAPVRLGDEYYPGKHSVRTDAEILQFIQQNGLAFYHAGSSCAMGDPDAVNSTAVVDSKARVIGIKGVRVVDAAYVMVSDCTRRDPTLGCGTNSHDRALPFLPPSHIQSAICMFIALSPGSSQHVLYCCIH

SEQ ID NO: 42491 - protein, 237 aa, A.fumigatus
  UNSURE (172),(178): Identity of amino acid sequences at the above locations are unknown.
SRPCSTPQTAPPSAPTPSTRCWNAPSPASSWRCTTACASLTPTSAFCTKSSTSRCKSPTSPLTRPYRISSQPCATSPPSSPPGNAQQTASTPPRSTFTCASSTTVGTPAGWNATKQALSTAAKYALAPPPLRRRPRPRPKSPNSTFAFTSPPPSRAAWRCPRASSSGCLSPXCTSSPXLRARTPSSTRSSAGTASPASRTAHSSHLSTPSRMSSSVGGRSRRGPSRAAQTGTTSSRA

SEQ ID NO: 42492 - protein, 160 aa, A.fumigatus
TISCLLIYPNPDSALNSTAGALLQEDYDAFARQAKLMTSIHAPVPPDLRNAVVEAKSRGEEPGTLIPEHEGARCLRPRKGTRIQSLTMKTKKPSVTPRPSNQTNADTNDSHPESDDDSDTTRPSTSKENDPSLSPSPVKLAPPSPRKNSHGKRPLSDLTT

SEQ ID NO: 42493 - protein, 147 aa, A.fumigatus
PFPSTSSPPCTWAISTTRWAASRKTATSTRPSPRPSSPPSRGATSPSSPPTAAIRRSSTPTRWALPPTSKSPSPPLSVCERFSRLQSWRPFASVTSITPGNIPFGPMRRSYNSSSRTAWLSTTLGLRAPWGIPTPLTARRWWTARHG

SEQ ID NO: 42494 - protein, 149 aa, A.fumigatus
  UNSURE (110),(116): Identity of amino acid sequences at the above locations are unknown.
PGPTGSHPSPAPPPRHPLPLETRSRPPLRRPGRPLHAPLPPRSGRPRAGTQQSRPSPPQPSTPWLLLLFVVVLVLVPNPRTRPSLSPRHLHPGRHGDVPAPAHLAVYRRXAPAVLXCARARLPRRGRRPGPRPPLLGPRTARIYRRRRA

SEQ ID NO: 42495 - protein, 115 aa, A.fumigatus
RSSFRRLAADHAALHEELPPNYLFPTEESSDDLTQLTTLLAGPQGTPYSQGLWRLHLKMPEDYPKSPPKATFKTRIWHPNVEESTGAVCVDTLKRDWKSTLTLKDVLVVRVLQST

SEQ ID NO: 42496 - protein, 276 aa, A.fumigatus
ALVFPAPWSIPYLKECADLPNLTVYTETVAKRILFDDTKTATGVVVEMAGLEHTLAVDKEVILSAGALQSPQLLMVSGVGPARTLDSLDIPIVHDSPYVGQNLIDHVWFGAAYRVNVPTWTQWANDAFDMLRLYVDNYRQHRQGPLTANAGDFGAFEKVPSHLRAAFTAKTLQDLAEFPDDWPEVEVSTASPCVSRSHVHNHFPVHRLPHVPGRFQRPAGPPAERRLPVRVHHRGPRRPRLAGQRHHPVRRQPRSAGHQHQHAGLCHRPASRHRRL

SEQ ID NO: 42497 - protein, 597 aa, A.fumigatus
  UNSURE (382),(387): Identity of amino acid sequences at the above locations are unknown.
SITSSTNSSPANCGNSAFDIDSPPPPSSTLVHITSHRISTSIDNIPDLNMAATSVVAVIVIGLLTVLYISRKNGKKTDKVLLKLPLIGDLHSSPIEKPLANWDSWAQQNGPIAVPKLFGIIPIVVLNSNEAATELFNRRSQWYSNRPPSVSMEMITGAPPGRSRFTLMHDYDDHLKLHHRILSPSLGALAAPKYQPLMELEAKQLLHDLVKALQHSPDGATISTNTIYPLLERTQSSVILALHYGLRIPHPDERILHQVIDIQVQVTHLAANPALPDLIPALRHLPAILSPWKRAADRLYAAQVDLYMRLFHHGRDARGLERNKAGPLHRSQVRPGSSSSSSSSSSSSQIPELDLRFHLATSIQGGMEMSPRQLIWLFIAAXHQQSXVARAHAFLDEVVGRDRVPRFSDRAQLAFIDAVAHELFRWRPIAPGSIPRRADRDDEFQGVKINKGVTIMANAWGIGRDEQVFDPALGDLQEFVPERWLRAGEAGEERLRSDLPLPVFGQGRRICQGRRVAVDGTFLQVASLLWAFDVAMVDDGAGPVDPWEMVVVGFMTMPKERRFKLKPRGNWVLDVIKREWETAEKSLDKVMGTNDVE

SEQ ID NO: 42498 - protein, 124 aa, A.fumigatus
PCTSPDGDMEESTSLHVCQYLAAVSLSEMTVIFPIQTRDQRAVLAVAFTFSILAVVAVSLRLLAHHIAHKPWTASDYFLIAACVRQALAMGSTNNLSIGLSSSRSVSSPSVSLAYSRLVSASTI

SEQ ID NO: 42499 - protein, 296 aa, A.fumigatus
YPSKMIGIPLLASLLLSGIAQGLAIAERATTPVWLTLPPTPPLPAPISEARISVDGVELWIQKYNEDAHKTPLVLDHGGLGYSAYFGAVLSRLIAKGHYVIALDRRGHGRSTFKEDDVFTFDLFADNIYEQLKAVGVSKYNVVGWSDGGATTIAALLNRKISPTIEKAFLFGAFMVPSDSNPNFPNTDINSEFVSRCAKEYSQLQPQANFTSFATKVATLEATLPQFTTDQLRTIDGSRVRIAGAQYDEAVNLDVPAKLHAAIPGSSLVILNNVSHFAPLQDPDQFTRALEDFFYA

SEQ ID NO: 42500 - protein, 79 aa, A.fumigatus
SCISVKRDRPGGAPVIISMLTDGGRLLYHWLRRLNNSVAASFELSTTIGIIPNSLGTAMGPFCWAQESQFARGFSIGEL

SEQ ID NO: 42501 - protein, 167 aa, A.fumigatus
FFAVGLQSISITGVFQAGIGFDHMTSIVAVYGMEPVTKLFQLIIPLQFTWVLSLSCTKISILLLYLRIFPVVSVVRVAWATIGVIVAWAIATILAGCLICRPFAFNWDQTIPGGSCGDQVTSFTATGVINLVTDVVVLVTPMPSLYRLQMATYKKVTLITVFGLGVV

SEQ ID NO: 42502 - protein, 86 aa, A.fumigatus
VAKEVAHKFQPNAKLEAYHANIKDSQFNVDWFATFDLVFNALDNLDARRHVNRMCLAANVPLIESGTTGFNGQVQVIKKVSLSCSS

SEQ ID NO: 42503 - protein, 145 aa, A.fumigatus
CQPLKARKRQFGPRDAFTLRLCTFNTYEDTSTCKSHFDTATPSKYNEQVDASQTGCQCLGQSGCSIAHSSENQQAPSQWSVRLYDHPRCTCVGHGFNPDCMQDTFYSSTAHEHMVSAANLPNSAATYLCRRIIDPLPHLEPLSKE

SEQ ID NO: 42504 - protein, 84 aa, A.fumigatus
SRVLLVGAGGIGCELLKNLLLSGFGEIHIIDLDTIDLSNLNRQFLFRYEHIKKPKALVRLRRLTGSSAFPRSLALRLDLLRYAI

SEQ ID NO: 42505 - protein, 163 aa, A.fumigatus
VLYISAHEPQACLMLLSELFGTSEDESEEFDHSADADNGKHLWSSNVSQASYNPEAAAEIANLRKEAQALKAIRESMGSPEFYQKVFEKVFKEDIERLRGMEDMWKSRTAPQPLDFEKLQQESSSIEPIISVNDQKVWSSAEDFVVFKDRFETPSLMTILHEQ

SEQ ID NO: 42506 - protein, 493 aa, A.fumigatus
YYLMLFFLVTLFLHLHSHSSLTALIGRRQQPIHISTAADPSSPVVRLVICLFSAPRRQLLTHKTFKGVTRLLLLRVPFFRDIILESFECEHCGHRDNSVKSAGQIQEKGTKYTLDVENEEDFQRQVIRSDVSIFRVESLGIEMPKGESQLTTVEGVIQRIYENLSSDQPLRKEQAPELHDAFVPIIEKLEKILKREGFPFTISFDDPTGNSWIAPNTQDKTNKYRRRDYPRTHEQNEELGIAADPEAQKNEGINVEGEIDDSEIVEGQVYSLPAECPGCTKACFVNMKKVNIPYFKEVFIWGTVCDHCGYRTSEVKTGGEVPEKGKRITLRVENEVDLSRDILKSDTCALHSEELEVTVQPGTLGGRFTTVEGLLTEIRDQLHGQIFDVDDTTNSGGDSMAASDKEKWERFFSRLNDAISGKMKFVITLEDPMANSYVQDLCAPAPDPQITTEEYTRTEEEEEELGLKDMKVEGYEQEQKEEKPAEEADERKS

SEQ ID NO: 42507 - protein, 129 aa, A.fumigatus
QSNSLERLSRRLKTLQETAKDGLKPILFFDKDDVDTLDFVTASANLRATIFGIEPKSKFDTKRKLDAITDSFLLLILVSEMAGNIIPAIATTNAMTAGLCVLQAFKVLKDDFQNAKMVRATSELVPRVI

SEQ ID NO: 42508 - protein, 161 aa, A.fumigatus
GLLEIDRMIARAMSDDEADPELLALLRKSLGLDGGPANPRTAETKVLENAQFVFDNAVDVALSPAKVKEAAETIWRLMQKKNYSTETWTDHELHPKAKDGSTVDFIFTMDLLNFSFWSDQTDPSKRFCIEYRGKKWTGYWSLVAALQRALDEGKSSVKIFA

SEQ ID NO: 42509 - protein, 145 aa, A.fumigatus
RLADYRIPQMLHQLGCLLYSPSLEGHIRSNKLIPSGSNWEIELRATSIWCVELIRREIERQHPEVKKQKLLKGAPTESSVNGATSFENETNLAAQKHIRQASTHGTSGSGINAILIDFFLYDTAKEMERDGRETIPHHRTRSIWY

SEQ ID NO: 42510 - protein, 186 aa, A.fumigatus
NFLALCACGAYNNTPFHRIFPGFMIQGGDISLGPAPGTLNTLKPMLPVNEIPKGGTSIYHPRALNQEIHLPALRHNARGILSMASRPVKDRTAPGSQGATGATVNGSQFFITFAAAPHLDGASTVFGKVLNLSPQDEGGDVLSKLEKAKLKVDKKGRVTQPKEGEEGGYEAIGINSVTIHANPFAK

SEQ ID NO: 42511 - protein, 660 aa, A.fumigatus
PHLLECRHIISRMLVTDPKQRASLAEIMNHPWMNKGFSGPPENYLPAREPIQLPLDPEVVEKMTGFDFGPPEYITAQLTKIIESEDYQHAVRTSVREQPLQVHSEKKRGMFDFYKRRNSASRDTLSAPSVEAVQLGNDPLNAYSPLLSVYYLVKEKLDRERAESNPGALGIPHSAGENVLRMPDLPAPEAAHTNQYQLPGEKDTGRRSRPRARTHGDDDLNDGIKDLHLTPQAGQATPIPAIPPETPVKKESTAAGILRRFSTRRVKDRSRDPERERITSSQAPSLSVQPPADSASPLSRGFSMRRSRRADPLPSDTPGGGSQPQQQDFLKAPGSAEPASRSNKYLERSTSVNSAEYRPRRAARRNDPDVSDTAPDRQPPQTSGSDYSSLGGQKVETSAKEVKQPGRTHATRTMSLGHARRESIQARRARRDAAREANVPEETDADISGAGNALESANEGEDLSKPVYLKGLFSVSTTSSKPLSVIRTDIIRVLKQLSVDYVEIKGGFSCRHAPSIELDKVVDVGPPSPDRSGQVSNHRRRISFGGLLNHDDSKEDPRSMHTPRSQRRTRAPDRSFVSNSEGSDEYMAPRDSNAPAGERVMGETTTRVQSDTGENLVLRFEILIVKVPLFSLHGIQFKKVSGGMWQYREMAKKILDALRL

SEQ ID NO: 42512 - protein, 357 aa, A.fumigatus
VQRQSQQESQRSPKATFFSNLTHRTPSSSIPLKRKSDRSSVSPSLAVPKADHLTNNNIHQTTNKQGLGNHSNPITSNSNTANNAIAKANTPDPNHVFNPKIQNPSTPSPTPSSQQEAVGVVIPSPSRQLRKEIEKSVWVKAPPVTPEKTALSTEYYPIDAHEKRALRGAYPSARKVKRSEIPFSIETPGPILADRIPVQRQLHETLQRKLSKINGPPVTFAPGEEDLLAVFASNFEFVNSYILRKGVSHIPADFIAGCDCKKICDPARCGCLEQDEESKEIIVPYQRAQDDARLLVLTPDFLKRTDIIIECSSKCTCDERKCWNRVVQHGRTVRLEIFHTGNRGFGKLYKAIEAEEC

SEQ ID NO: 42513 - protein, 156 aa, A.fumigatus
PVGISGFHGGTHSNSSRRDHSKERSRERPTSAHRTDPSPSKHRRNLSVQSHQRDSIDMASTGPVVAEPAPPPAQAASGSHLHPSSSVQPKRRTTITTPSGQWALGKTIGAGSMGKVKLAKNMETGEQVFRTEATDLTLTLMTIAGGCQNSTETIGR

SEQ ID NO: 42514 - protein, 213 aa, A.fumigatus
QLQVAVKIVPRQSADEHRSSRDTERADRSKEIRTAREAAIVSLVNHPYICGMRDVVRTTYHWYMLFEYVNGGQMLDYIISHGKLKEKQARKFARQIASALDYCHRNSIVHRDLKIENILISKTGDIKIIDFGLSNLFSPRSLLKTFCGSLYFAAPELLQARQYTGPEVDVWSFGIVLYVLVCGKVPFDDQSMPQLHAKIKKGHVEYPQGLSAG

SEQ ID NO: 42515 - protein, 159 aa, A.fumigatus
GGRVLMRPGLRSPDWIRAGQFIDCYLGEVITKQEADVREEVVTSQHGHSYLFELDFFHNDDEIYVVDGQKFGSPTRFMNHSCNPNCKLFPVTRTYGDERLYDLAFFSLHNIPPNTELTFDYNPNWEEGKKVDPNAVRCLCGEKNCRGQLWPNQRKGTKC

SEQ ID NO: 42516 - protein, 72 aa, A.fumigatus
SALSDYLVLLSVIISIIPSLAGGMDYHHIHAIAGSIYSMQGQMTETRWTDLFQSPLYPSRWTLEWHAAWQSQ

SEQ ID NO: 42517 - protein, 213 aa, A.fumigatus
NISTSQQQHSNRTLLHRHHLHTTYTQTSTPKRETDKTAKMHPNLSLTTSFPSSSPNNHLPTSTATSPASSASPSASSPFSFRLFHPYRGASPSSTGSISANRSRSTSPLRLSALFLCRRPSKVDLALSAERTRCDGDAIERQGLDLMEPRPVDPVDYRLPMDGSIFASSALTQGFEASRGRSSLHSQLHTQPYGFVRPRFVMGGIFEVMEGRD

SEQ ID NO: 42518 - protein, 90 aa, A.fumigatus
WAGPFDRISNRRSSCIWNEPVSLAFPVSYSYSFKVQTSKKLFAIGTPFFVDSRDLGLKRYLGAKPQQVTPWRCVWMEQTSHGFNDEDERP

SEQ ID NO: 42519 - protein, 194 aa, A.fumigatus
TQKADVGSVILKYAGRDATKAYSEVHSPGVIKSNLPPEKYKGILDSSSIDEEWLKQPPSENPQVVLDDEKPPLHTLINSHDFELVASKTASKKTWAFYSSASTDLITRDANKSCFDRIWFRPRVLRNVRSVDSRTKVLGVDCSMPLFVSPAAMAKLIHPDGECAIARACERKGIIQGVCHDLISHSVSLHNAKL

SEQ ID NO: 42520 - protein, 96 aa, A.fumigatus
PTAPLNIRFRFISCSYSSIITLTWSLRKNLSFKPVICANFKRVKMAGEKLLSTKEVSKHKSPDDCWIVVNNKVWDVTDFVEEHPGGSTSKSCWLLC

SEQ ID NO: 42521 - protein, 263 aa, A.fumigatus
SYIPFSLIAQRQALVLIIGQVSNNSSYTLDQLREAAPSANFFFQLYVNRDRTKSAALLRQCSANPNVRAIFVTVDAAWPGKREADERVKADENLSVPMAPARAKNDKKGGGLGRVMAGFIDPGLTWDDLVWVRKHTHLPVCLKGVMSADDAILAMQAGLDGILLSNHGGRNLDTSPPSIVTLLELHKRCPEIFDKMEIYVDSGIRRGTDILKAICLGATAVGMGRSMLFATNYGQEGVEHLIDSRCCPMYNPMKLTSNCSYER

SEQ ID NO: 42522 - protein, 185 aa, A.fumigatus
QARLPAGFCYATVGVHPCQAKLFDEFPGGPDKMLEELKSLALEAKAAGHAVAFGEIGLDYDRLFLSAKEPQLKYFEAQLDLAVEIQLPLFLHSRAASEDFEKLLAPRLEKLPKKGLVHSFTGTMDEMKRMLALGLDVGVNGCSLKTEENLEVVKAIPLDRIQIETDGPWVWSSHLPYNILTFFPL

SEQ ID NO: 42523 - protein, 64 aa, A.fumigatus
CEIRPSHASAKHLEGSPALPKAVKKEKWQKGLMVKGRNEPVAIAHVAHVIAKLKNITAAEVCEA

SEQ ID NO: 42524 - protein, 76 aa, A.fumigatus
FDVPGVDLPSWHLLTKKAVYFPITTKVTQQRSDFSCDCCSGHDILSLDYNGLNMRPSLLKQNDVTEVVAVFLTCNR

SEQ ID NO: 42525 - protein, 98 aa, A.fumigatus
HRTGCIVGCFRKVQGWDMPAIRKEYLNFSLPKSRPLDERFIELFDDTRLGPLAVSSGASSWPAGVMLDPLREEVVEDENTPRGSRHSSASVFHKSDAM

SEQ ID NO: 42526 - protein, 114 aa, A.fumigatus
IGINLGDPVFRGEYHGRQVHDNDLDDVIQRARDVGCTKFMVTGSDLVESRHAIQLAQSYRKLRTQHPYPLFLRAIKPNKLGCQLVSVTQLLVFIHVKQSSLMNFLAAQTRCWRS

SEQ ID NO: 42527 - protein, 186 aa, A.fumigatus
KLFPATLAFPSAKEAGTQDDCVSGCHIRSLPLSYACPHSTLVEGDYTQDHQVFLKENGIEHRRILILANKDPTIRTPDHVVNRVLEIMLNKTNHPLLLHCNKGKVSANADNTNSTRLTRLNSIGLDALSAAFGRFRAGTCQLFARNTSIFRCRNQGLSTNDSLNFSMTPDSGPSLFLLVQAPGLLV

SEQ ID NO: 42528 - protein, 511 aa, A.fumigatus
TLGLVSPTAVPFTHVRLGKSTFQITTCVGRALHTYDLRRGLSLIFVSRPQTPEAITATFAWREKVFAAWGNLRPGTCGGIWVFKRGKKVAALEVPSGRAGPIIKVLVFGAWIVGCTGTSIEVWKNTTYEHYTTLIPHGIEAVSGDHIYGGQMCSMPTYINKVFVGRVDGCVDIWNVRTGQLLHTIPAAWPSVGAVTALQPTPVLSLIAIAHADGSLFIRNVDTEQIILSLRSGSSHITSLAFRTDSLGAGADGQSPGVLATASADSGDITLWDLNNAGRVTGVLRNAHRTLQNEIASGVNCVDFLDGQPLLVSTGKDNSLRTWIFDETPFSPIPRQLHFRSGHSAPVTVLSFLPSATDGSEANGKWLLSASKDCSLWGLSVRKDSQNTEISQGAVEKKAKKMSAQGPVSLDIQHRTQGVRASEITCIACSLNRDGGMGVTTSGPIWANPRAADAAASNKTGWESIITGHRGDKFARTWFWGRKRAGRWTFETSDGSVVKVNDCQQYATEYR

SEQ ID NO: 42529 - protein, 115 aa, A.fumigatus
MIVNNMPLNIANTLLQSVAITQCGTFALIGSSMGSIDVFNLQSGQHRQCFPARGLKSRRTGELGLANGSQEKNIGHTKAVTGLVVDSLNRTAISCGLDGKVKVRYTTPQHNHNTD

SEQ ID NO: 42530 - protein, 230 aa, A.fumigatus
FWDFHSGLLLDELDWHPMTAITGLRYNSSSDLVAFSCDDLSIRVVDIETRKLIREFWGCVGQINDFIFSNDSRWIVAASMDSRVRVWDLSTGHLIDIFRVPSTCTSLSMSATGEFLATAHSDNVGIRLWTNRSLFIPISTQNLDESVFADSHIPITSAEERAGALEAAFAEEDHQDEAEGPVLCDEQLSTEMVTLSAIPRSRWQTLLHLDLIRVWSHASSTICFIIADCC

SEQ ID NO: 42531 - protein, 114 aa, A.fumigatus
ERNKPKDPPKAPEKAPFFLPSVSEKSSIEISDRSTVLSVEHTLAERSRIARHQRSQTVDDSGSLFTVLLHSGRQSNDFAPFIDYLKSLSPARTDLEIRSLWSTTGLEEPQPQTQ

SEQ ID NO: 42532 - protein, 483 aa, A.fumigatus
VNVAQIWACSFLDQKELPDDFIQVRKDLLDDSNAAKDVMDKVKKKLKLLLREGSAPSQFTWPKDNIPEPSVVLATVVELMKFHRNVMRHNFEKLNNSPHCASSISPLSDNPTSQDVIQGTVSPTLTSIQGRWCTGEDPMLFKERWEKLFAEFCDTEKVDPSKLSELYDSMKFDALHNRHFLEWVFMPPDEGTNEHERHSSNSNNTNRHDLAEDRLPGHDSLTSEGIEENVENPTLSHLLRFKKRAHAFDSIPHLRALDDSYDHYFKLYPGSSPTKTKMDGRLSKLRELYKLAKVLFDYVTPQEYGITDSEKLEIGLLTSLPLLQEIVRDLEEVQASPDAKSFFYFTKESHIYTLLNCIIEGGIQTKIARSAIPELDYLSQICFELYEAKDCESSTSSYSIRISISPGCHAFDPLDVQLDSRHAIGCAPRRSLTAHQDWKEVIETLKAKFDTCVSQPTFIPLRFIGPTTDQNSLGLNFPRLSLP

SEQ ID NO: 42533 - protein, 869 aa, A.fumigatus
ALHIIFSLENLAQTHKHKKENKLYRAATEIWDESFQAQPQSLRFRFYEQPSKMTQSNSIQDFPPSATQDNCSSDIGCATGSDERNALIATPLPNMVPDQTGDKSSFTLLYDPVSPSSRASPSNGQFHQNKPQTSDVMTDHAGGARVALSARSSSRTPRRLSGSTATSSVSEAETGPSSIGRIGVCALDVKARSKPSQNILTRLQAKGGFEVIVFGDKVILDEAVENWPVCDFLIAFFSDGFPLEKAIAYARLRKPFCVNDLPMQKVLWDRRLCLRILDHMNVPTPKRLEVNRDGGPRLESPELAQHVYRLTGVKLEGPEDGTGGGSQKTQVVTMSEDGEALIVDGKSIRKPFVEKPVNGENHNIHIYFPNDHQYGGGGRRLFRKVGNKSSEYDPHLVVPRSVTEKDTSYIYEQFLRVDNSEDVKAYTVGPDFCHAETRKSPVVDGVVRRNTHGKELRYITKLSQDEAAIASKISNGFGQRICGFDMLRVGDRSYVIDVNGWSFVKDNNDYYDKCASILSDMFLNEKRKREGLQRSLEMVSPDTSHHVRHSVSHRHTLKTLLKSPSTSKLYGGHKSLDNSFQDLAALPPASCGAESMDYKRSRTSPDARQIDSDIGDLDQKNRELTGHPDETIPPPPPPASKHSWKLKGMVAVIRHADRTPKQKFKFTFHSQPFIDLLKGHQEEVVIKGQAALASVSDAVTLAMDQKLEHMEKLKLLRTSLEKKGGWPGTKVQIKPMFRERTQEELSMHSSENSNSDGAQINWTQVADDASGDKENFPRTSTRSDSISGTTFSRFSAAENDLILDKLQLVIKWGGEPTHAARYQSQDLGLNMRDDLKLMNKEALNNVRIFTSSERRVSTSGRSFPKHVSV

SEQ ID NO: 42534 - protein, 66 aa, A.fumigatus
VCSIAIKIFDVTQTIASKRQLVSIETKTNISNIKSLFPVIRGPGICCNPVDQYSALTLRLMASSPP

SEQ ID NO: 42535 - protein, 93 aa, A.fumigatus
PLVTPLTLHLGLISVIVAYRFSIQGGSIICWHSSFLVQIEMTQFTPAYNDFSLRNESSVPSRKKCKREGGKWTRSGCLTCKRRRKRCDEAKPG

SEQ ID NO: 42536 - protein, 137 aa, A.fumigatus
AHRLLTQVVVTGARVFGRAFAEAYKQASASSKYAQANKGKGGSSSTFASSGLTLEEACKILNVKPPAGGETNLEHVMERFKKLFDLNDPKKGGSFYLQSKILRARERIEMEIRQAERKAAQEKELREGWNPKVYKDR

SEQ ID NO: 42537 - protein, 101 aa, A.fumigatus
DSSHTLADADDARAYFSEKYKHDSELPSQGYDTCVNMGDKYIVNDHPHFAGCLSENILVKTSKYPQILFEMWMMSLMIYASECYYILGKVTLFSDEKPKNG

SEQ ID NO: 42538 - protein, 301 aa, A.fumigatus
QIFLSFLSPRLITGLLIVSSVKIVAHYSSYLQELRGGLQVAITIMGRPSVPLSADLPPLIMGTATFNSQYNQDPYALPTTELVHRALENGVRAFDTSPYYGPAEELLGRALATDYVRSNFPRHTYRLLTKVGRVAASSFDYSSRWVRYSVKRSLRRLHTDYLDVVYCHDVEFVSPEQVIEAIRELRRIRDTEGTIHYVGISGYPVDVLCNLAELVLRETGEPLDAVQSYANFTLQNTRLLTQGLPRLVAAGVDVIPNASPLGMGLLRRKGVPIGSMGDFHPAPDGLRKAIRLHHGAGRSRA

SEQ ID NO: 42539 - protein, 81 aa, A.fumigatus
DCQRLGDLGRWKTSASSIDGWCLGWDRSMDRLIDPRAVVRERREKLKPNSRYTLYASPTIKEDKRYTLNYSCSVIVRAGSI

SEQ ID NO: 42540 - protein, 440 aa, A.fumigatus
SIAPLLSPARKKQHGSGLVEEYTGDADAVVEDIPWIDSMAPSYAQDDGLQPDSQPPTVAAFSPTTISGSSLTSRQRSSIIVHRKSPLLVATPPAITRALAYSHPFILPLNKLAGLLTWTTDDPWQSFLLVAGFWTVVLYSDAIILWGGPILVVVGLILGMYWRRFSPLSTAAFTGEKRQHQKSVSEGSSHQHETLDEIVETLRTFTTRCNILLEPLLELTDFLSTQRTATSATTRPALTTMFIRILFVTPIWIALTLPPFYIITTRRVVMTIGTIILTYHSRPARVSRVILWRSLTVRRICSMITGLSFSLNANQSQSLWAQSHGHAASIATRRRGDSSGVRFTFVLYENQRRWLGIGWTYSLFPSERAAWTDEHLNPAPSKDDFELPHVQAGNAKWRWVEGSEWRIEGADDTNSKADGKAADGGGWIYYDNKVRPHLRP

SEQ ID NO: 42541 - protein, 206 aa, A.fumigatus
GPIDVDEVTEIEALCMRHPAVLAEIEKLKLPPGMAVCNDPWMYGSDSPNETRRLFQCFMYMVEVDHPENNHYSLPCKFSPVFDASTRELVRMDYLPGGTDTKVTETQPWRPVKTIQYAHDLLDEPLRNDLKPYIVQQPEGASFSIDGNSVYWQKWRFRVGFNNREGLVLYNITYDNRNVFYRLSVSEMTVPYGGELAMRRRVRALY

SEQ ID NO: 42542 - protein, 210 aa, A.fumigatus
WNDGRRGQDGWDRYTRRRKWCRDAELVEIPQATENTPATAKSGLTQALDKQRESGNIDASTVDTDAVSLSPSASSKTRKRRWFGGSKPVSDKASSTSFALPAFTNTSSVDAGKITSTPSYSPSGTHVARPIDIAHSRKPSNYSGNASHGSVGRDSSVAGSVSHSDSASIRDKEIIHAQDHLDRWGTRATGGIERAERELGLGDEVNMGLS

SEQ ID NO: 42543 - protein, 78 aa, A.fumigatus
VNDCMINSRSIVSSHSHPVMKSGKVSAEYSQWSSSGDERIILRQRSTAPRFDNDMKEVQNEDALCVNPRIILSSVEWR

SEQ ID NO: 42544 - protein, 137 aa, A.fumigatus
YTNPSLCSMLASQSSPSTTSVSLHPFDPITPEEIKLAVRILEAAFPGVTLRYKRIDLQEPIKKDVIAYIEAERLRKPLPQKPPRLLFSYFHRLDSGVFHKALLNADSKSVIHIKELPAHVQVSRSFLFPFPSACPDS

SEQ ID NO: 42545 - protein, 417 aa, A.fumigatus
AGHETKSKSTVLINWIATDPRAPYHRKQAFDVGDVGFGLNANQLTLGCDCLGHIKYFDGYRTDSKGNPVHLKNIICMHEQDNGLQHKHTNYRSGAATVVRNRQLVLQMICTVANYEYIFAYIFDQAANVELEVRATGILSTVPFDNENGETVAWGTNVGPGVMAPFHQHMFSLRIDPAIDGFKNTVYYEDSVPLPEDEKNPYLVGYTTEQTVIRKSGSANTDINRHRVFKIRNDNIINPVTYKPVAYKLQTAPSQMLLLSQNAMGYRRAEFASKPIWVTKYNDDELYAAGEFTNQSRRAEGVETWVQRNDSTENEDVVLWHSKLPRALWVSQSGLTRSAAFGLTHNPRVEDFPVMPMERISVMLKPDGFFTKNPALDVPPSTQSFNKSTLHAEPAPVARCCSNGGASTKAKLYKRIE

SEQ ID NO: 42546 - protein, 61 aa, A.fumigatus
YFPFDFNSIKKPKTHRYPSLKGVDPKFRRNHRHALHGTMKALVRWPCCCLGRKQPDVGGHG

SEQ ID NO: 42547 - protein, 306 aa, A.fumigatus
PTVSIMLYAEGDKLIYRFDDHILWIQPWSENAFRIRATKLASMPSEDWALSAKPSTQQPIIETPAGKEARISNGKIKAVVSQRGKITIYNSNGKKLLEEYARHRRDPMDPKCSALEIEARELRPILGGDYHLTLRLESLDPKEKIYGMGQYQQPYLNLKGADLELGHRNSQASVPFALSSLGYGLLWNNPGIGRAVLGTNIMSFEAYSTKVLDYWIVAGDTPAEIEEGYCKVTGYVPMMPEYGLGFWQCKLRYWNQEQLLNVAREYKRRNVPLDVIVVDFFHWKHQGEWSFDPEFWPDPGGSISAT

SEQ ID NO: 42548 - protein, 80 aa, A.fumigatus
  UNSURE (34),(35),(43),(51): Identity of amino acid sequences at the above locations are unknown.
RGLPSYLCNVMATSHIFDPNNPRGFGNISWKKAXXTTNNKGSXISGLDKPXLKYPIYDFEYLTVPRLGTTLQFGNLFPPG

SEQ ID NO: 42549 - protein, 117 aa, A.fumigatus
LSLPSVFIRPYVSADFLFFSFLPTYLVSSVMEVASMTQPDPTNGAHLTSIAMDASMDIDMDIDLGPLPEPESIEIVSDNGPILSACLSLITNVSQPSLGTRDDNSYYSRRLGRSHNG

SEQ ID NO: 42550 - protein, 66 aa, A.fumigatus
ALRCDIVGPRRCRIASYSIALTSMRSSVSGGFAVVQPDSALSINAVEAYPLEDFSADVSCGNEEMS

SEQ ID NO: 42551 - protein, 431 aa, A.fumigatus
EPATTTVTTQDGLVDPTTAEAQYEKVHIRGVDDLTTDNIKQFATDYFSGETPSRIEWIDDTSANIIYSSPEVGLQALAAFTQASEEEDTSSFPPLRLRSAKALSTHPESVLQVRSAVKTDRKKPRAYEASRFYLMHPEHDPREKLRRELAERRRQGGQGSSDGDYQRRRFDGRELRRRRDRDADDNFSANMYDDEGPRASTDYSDSERGRNGRTRRGQRELFPDEGRLSGRLRNRSASPGRDTLAESGRLEQEERGTRSRFRERSPQLIRRNEGKELFPSRTSDSDSNARELFPNKPASSYLKKELFPSKHSNHRRSDAIDAADETADLFSRRISVPRADGARDQNSSRNKNIELFPDSEDQTGVSIRGAAGQDQGISIRGAANGMSIKGRGSSVRELFPSKYNSNAGKELFSDKIEGRGGPRRRAEDMFG

SEQ ID NO: 42552 - protein, 408 aa, A.fumigatus
HDPAPSTPNVIQTPSSANLLACSVEPWQNPSQEENQEGASHYIVATDADRQVHLFKADKGNDVVTSFAGHSDSPVLSYATIQNGKYVLMTNMSGQLLLQRGAEILSRRKDHAKYAVKVIAYEDEQPGETASNAVWVATAGWDSKILLYRLRIPSRAGDPAPVELKEPITSINLLTNPESILFVRHPDTKELVLLASRRDSTYLFYYAVPPSTPTEAPTECKLLGKQNLAPHSNAWVAFSPSCLALSPHDPGLIAVAASTLPHMKVIIVRLLFPNQGPSEPTPSMGGTSAQPETQATQAFEALALQNREDAAIMIQANTFAPQTVYSTPQVVWRPDGSGVWVNGDDGVIRGVEARTGKVTATLKDGHQVGSKVRAIWAGWVQVQRDGKVVKEEWLISGGFDKRLIVWRV

SEQ ID NO: 42553 - protein, 132 aa, A.fumigatus
RPIAKSPAHTKPVDSISCTQNTTPGRNYDENSQKDVVKVAKAQAMATINEDGLTAGSLDGGETVTRTTTSVPICTTTKARVLAPTIQTQREVATDEHGEASGNYSLTKVVYLAAFGIGAPLQVAIPWPRVVV

SEQ ID NO: 42554 - protein, 77 aa, A.fumigatus
LCSEHQRRGGLPPRGLQRRCKLWKRRNVLIYFFDPIFQLQAVKSQIAEAQKIANGSGSEQDIAEAKIELEVGQPRTR

SEQ ID NO: 42555 - protein, 69 aa, A.fumigatus
LVNMSIKIRYPGCLSTYEFAALIGIHNASCCVHGSVRYLGNNGAVCNIKEGFNSCLRKRGHRIEGITKH

SEQ ID NO: 42556 - protein, 145 aa, A.fumigatus
KRGISIYSFRLLAIAMFRLNLRRSKSWFKHSAEGCFISCLRYPQARTMVCSQGAPPQQSPSGNMKMDPLQSIEEEELPLYKPENYYPVDIGEVFVSRYQVVSKLGYGTSSTFWLWRDLKYVFKGPWMQINDILQRKMLQDAQNMC

SEQ ID NO: 42557 - protein, 104 aa, A.fumigatus
VPRFSPDNMFPNDLIQRSTQLTLIALAFLHENNVIHTGKYIAQGANVHAKRKVDISPNNILQGIEDTSILSDNYSLIYLLVCMAVTAWSLVYKMSFLNVLAAEK

SEQ ID NO: 42558 - protein, 259 aa, A.fumigatus
GTPKCESVYMSNAPTASISAIVTEKNQGATSRQHLSNETQPPKMSESAHREYTPKPLPTTPARDTRSPLQTHHPLSITMLQEPDSTANEQKQLSAPVVKAQHAIQSLVSSQPAQLKNRQCALQPRQPLTVLSQASNAAVKGEQHTGKLIKQPAPRIFHLGMFEVRKALGKGKFGRVYVAHKQSTGFVCALKVLHKSKIQQGRVEKQVARKIEIQSNLRHPNVLRLFSHFDESKRIILILEYAGKGELYKHLQREDRFPE

SEQ ID NO: 42559 - protein, 170 aa, A.fumigatus
YWSMPAKGNYINICRERTVSQSRNLRSTLHKWRMLLYICIASMWIHRDIKPENILVGIHGELKMSDFGWSVHAPSGRRHTQCGTLDYLPPEMVDPRKCDKPYDQKVDIWSLGVLLYEFLVGRAPFEDTPVMTQRRIAKGDMTVPSFVSPEAKDLIKKVSHRLLFNNQNDC

SEQ ID NO: 42560 - protein, 84 aa, A.fumigatus
VALNFDLASYLLFNPALLNFTFVENLQCAHKASALLMSNIYSSKLSLTQRLPDFKHAQVEYPWRGLFDKLPGVLFPFNRSVRRL

SEQ ID NO: 42561 - protein, 180 aa, A.fumigatus
NSQFNMADEPGQPPALTTLSLAEKAPASKAVAQVVTPFDVSGGVDESGKLLPVDYDKLVREFGATRISKELLERFERVTGRRPHRFMRRGIVFSHRDLNLILDRYEKGQPFYLYTGRGPSSDSMHVGHTIPFEFTKCVVHFLLDVSENELTRMALPDGCRMSLIALWLSCLQTTRRVLHH

SEQ ID NO: 42562 - protein, 284 aa, A.fumigatus
KYMHSQKIEVDDAKKYAKANAKDIIAVGFDMKKTFIFSDFDFVGGAFYENICRMAKRITINSVRGTFGFNDSNNVGEFHFCATQSATAFATSFPHIFGTDRKKVSSIPCLIPCAIDQDPYFRQCREHAEKMKYKKPSLIHAIFLPALQGPGSKMSASVETSAIFMNDAPNRIKNKINKYAFSGGQDTAELQRQLGANTKDDVPFQYLTFFMEDDEELERIRVAYEKGEMLTGEVKQKCIAELQAYVQAFQERRAQVTDEIVAEFMRPRSLEWKGNPNPIVVEKK

SEQ ID NO: 42563 - protein, 302 aa, A.fumigatus
RALSIPLSTASIVHLLCVHFVMTDAMATITQSQASESFQIISSLRYEPALPELLKAQCTDAYPDPLRSPYYLLPYHQERLRKAADCFGWRKAATFLQQDVESFVEHLNSFIPDRTKPWRLRIVIDRDGTCTVEVNAALQMDALNLLLPSKMNQTDTPWRVTVDSQRTVPSPFTTHKTTSRDVYTAARLRAKITSPQDPAEVLIVNPQGEIMEGSITTPYFRRRTSASTQAKIDQEDSGPAWITPPLSSGGNAGTTRRYALSQGFCSEQAITIAELIDGEECWLSNGVRGFFRGRILLNESKP

SEQ ID NO: 42564 - protein, 318 aa, A.fumigatus
QELLPTTDKAQGSDEHHLPQTSGFSVATSAPASSSRFYGLLYASATMKFFENVFTYDYSFPAVSLAYFLRYPNPYSRHVLTTDVIDRYVDPKTERLHTVRLHLKKSKVPSGILKLLPKGIGGSDNSGQSYILETTVVDIKEGWMETESRNMEWTGILSVVEKQLYTRQPIEGSLESLQGLSLDAQRNEQTQVKTTVTFRSRLGQGKFLGKKKTIPTADQTIEFDEETPKKGFFSSLSTAGIQRTIELIGVSRTRDAVLKSKEGMNVVLERLRNGGIVGVLEGMRQDREAAFGPDGPWKRVWLRGNGLKDRAFTDDDDN

SEQ ID NO: 42565 - protein, 159 aa, A.fumigatus
KLSMSLQLGSASVFRPGWALSILVVLAALPSAIAQFCTFWDGGCVDPLAQTAINFDFPPLFLDDLTLYYGFDANPSGKGQEPMVKASFWLAYDPHRIDSTVITANRTSEIAFRVGNLTGTPSGPSNGCDGVWGPQCTHDLKELLVFTRQWQSSSLEINP

SEQ ID NO: 42566 - protein, 93 aa, A.fumigatus
RKFTDDLKQAAVDVETDALLQRTLRSSVFQERTIITIAHRINTIIDSDRIVVLDKGRVAEFDTPANLIKRGGKFYELVKEAGLLESDGAALVQ

SEQ ID NO: 42567 - protein, 77 aa, A.fumigatus
LHCCAGWMCIYDLALTYNVTESINQESRAICRTCPSKRLPSLHMRPNSEYGFAWDSPASTKPINFYNSSSPRRWSLR

SEQ ID NO: 42568 - protein, 143 aa, A.fumigatus
RGLLEAGFLLADASASSAAWDILACLLSKAESCSSSLSSSSSDDSEPDIDSSKSPTALANCASSNVGLPRDCALTLNLWWSDRTCSRCSCTFRKETLQSAQDVELAITGSSVDGSSGSLESSTVSSTAMGWSSPLAVKVERSS

SEQ ID NO: 42569 - protein, 964 aa, A.fumigatus
IVLGALIFTTALQAAIQAESAPRLFLADFRFWSSILVIASLGVIFAVQYYEHWRSRQPNGVVLFYWLFFTIAYGVKLRSLVSQKAYQDQLPYFVCINVSLGLALLEFGLEYLVPKKQSAYDALGDEDECPYEYADIFAVLTFSWMTPLMKFGYKNYLTQDDLWNLRQRDTTRVTGAILEEKWAEELRKSKPSLWLALMKSFGSPYLRGAIIKCGSDVLAFVQPQLLRLLIRFIKSYGTDEPQPVISGVAIALAMFSVSVTQTICLHQYFQRAFDTGMRVKSALTAMIYTKSLRLSSEGRASKTTGDIVNHMAVDQQRLSDLTQFGMQLWSAPFQIVLCMLSLYQLVGLSMFAGIGVMILMIPLNGVIARMMKKLQIVQMKNKDSRSRLMTEILNNIKSIKLYAWNTAFMNKLSHIRNDLELNTLRKIGATQSIANFTWQSTPFLVSCSTFTVYVLISDHPLTTDVVFPALTLFNLLTFPLSILPMVITSIIEASVAVRRLTDYFTAEELQTDAVTFEEPVTHAGDESVRIRDAAFTWNRYQGENVIENIDFSARKGELSCIVGRVGAGKSSFLLSMLGDLWKTEGEVVVRGRIAYVAQQPWVMNASVRENIVFGHRWDPQFYELTVEACALVDDFRNLPDGDQTEVGERGISLSGGQKARLTLARAVYARADIYLLDDVLSAVDQHVGRHLINKVLGRNGLLSGKTRILATNAIPVLKEADFIALLRNKTLIEKGTYEQLMAMKGEVSNLVRATMNESEDEASSSDDHDLASPEGSETTTVLENAESEPSDTEAEQQIGSLLPLRSGADTTRRRSSTVTLRRASTASWHGVRRKLGDEENVLKSKQTQETSQQGKVKWSVYGEYAKNSNIIAVCFYLLTLLGAQTAQVAGNFWLKKWSDASEVQAQPKVAKFIGIYLAWGLGSSILVILQNLILWIFCSIEVWPESYHKVKNYINTTAGFSQTA

SEQ ID NO: 42570 - protein, 76 aa, A.fumigatus
SACFQTVADTMAHPHLDSLQHIKVILRSVTVTPVQKVDTRRQFQSITITEEKAAISLSHGIVVPRCAVQRDILSIY

SEQ ID NO: 42571 - protein, 61 aa, A.fumigatus
FSGFFARLRYGLNRITRLRTTLIRQQASRKLHERMAFSIFRSPMSFFETTPSGRILNRFSR

SEQ ID NO: 42572 - protein, 262 aa, A.fumigatus
LFNNSAKAIFTMIVIATSTPAFILMIFPLGYVYLRYQKYYLRTSRELKRLDSVTRSPIYAHFQESLGGISTIRGYRQENRFALENEWRMDANLRAYFPSISANRWLAVRLEFIGSVIILASAVLAIISVASGSGLSAGMVGLAMSYALQITQSLNWIVRQTVEVETNIVSVERVLEYANLPSEAPDVIFKNRPAIGWPAQGAVTFKDYSTRYRPGLDLVLKDINLDIKPHEKIGVVGRTGAGKSSLTLALFRIIEAAGGSIR

SEQ ID NO: 42573 - protein, 78 aa, A.fumigatus
LPDLVVFAISNVFFSIDGLDISTIGLSDLRGRLAIIPQDPAMFEGTLRDNLDPRHVHDDTELWSVLGTLGLTRCMPKH

SEQ ID NO: 42574 - protein, 628 aa, A.fumigatus
  UNSURE (584): Identity of amino acid sequences at the above locations are unknown.
PSLVYDLPQELLSTLTAKGEDQPIAVEDTVELSSEPLDPSTLDPVIANSTSCALCKVSFLNVQEQREHVRSDHHRFNVKAQSRGNPTLDEAQFAKAVGDLDESISGSESSEEEDDNEDEQLSALLRRQARISQAAEEAEASASKKPASRSPLYWFSSSLLPSNTSLGVYRALFSNDEQDEPKHLVDSLRKKQLSPLPTQRPNAQPQTNGTTPSPHIFMCMIGGGHFAAMLVSLTPQIHRKQGGVEERQACVIAHKSFHRYTTRRKQGGSQSASDAARGAAHSAGSSLRRYNEAALEKEIRELLRDWKEMIDSAQLLFIRATGNTNRKILFGQYEGQFLKQNDPRIRGFPFSTRRATQDELMRCFKELTRVKVSQIDEAALAAVVAKQRAEAVKPPTPRPQQKPKVSKEEEEAILHTSQIQALIRRSKVPALMSYLSKNSIPSSFSFRPPDSPQNFRCPTPLHFAANLNSPSVVSALLTKADADPTIANGEGRTAFELAGDRATRDAFRVARHELGESKWNWDAAKVPAAVSKEEVDSRAKRERKIAEEEEAKRRKTELERLRKEEAAKAASLQETRKVGGRALXAMEKTASEKREEEMRGMTPEMRMRLERERRARAAEERIRKMQGR

SEQ ID NO: 42575 - protein, 73 aa, A.fumigatus
QTHRKGALFSGDDQVKTQIRFELSYQPILPRLNTLLDEVKELLLAEDLISDKYISVSSTNPHIYYCTKFLYSD

SEQ ID NO: 42576 - protein, 131 aa, A.fumigatus
VFEDQYPITQRKLGSGAYGQVHMAFNKVTGQQLACKIVDLRTPKDRVIEDFEGQKSRFFGMDTDRIVAARAHNGYIARKIHEKLEIYDREARILARLCHVGLLESHQNGTNGQSKPNIIRVEKVLRSSNTM

SEQ ID NO: 42577 - protein, 248 aa, A.fumigatus
KNPLQSGILKNSSGNVPQTAHATENFFINPARMDNVDTKEITLQNTLQNAGRRRSSSNMGAGSSSRRQSLASIRGHDEQISPRLKWDEANLYLTEQEKTAKMKIDEPKTPFAPHYDPAEDDEELRLAEAEESLIDAQDVVVDELDKTKKGTRKGISVDDIPDLELGEPEEPSYMVGSGEGNRIIRERSLSNESHRSDKHVVVGTGEENGVGADGDHLMTTEEAKEKHRQFEQMRKKHYEMRNIKKLLA

SEQ ID NO: 42578 - protein, 72 aa, A.fumigatus
KGVYYTLLHSYLTEYLYSVGKNRTYKVDVEGLTEGRDNNNSGDREASYSLFFIFKTDIITQSMYSVEGNRSR

SEQ ID NO: 42579 - protein, 1104 aa, A.fumigatus
FSYQKRCQRKAPWPGCPSGIFAGLCYSTLNVSPTIFGLSDEKRVNCSNSLILPDRHHFSMTRPAVRQHVENMLHQFQTTDNDNMQFAQRSQPKSHQESPCAFLMLSATDVLTLLGALFPTATSPACSSPTPSAASSALSPSSLQSFPDRRTNTVPEPGFYRGNLSGGSSPQLSSTAFPSADIHFFTCSEDHLSRNADRIRFELSALVEPDGRPGLAYPSTEEWAIFSVTDGGHRLVWGLFADGQLSDAGNLSADTCPSTTLGMEDNFEALHTAIIKLVREYPTGDRSDYCGERGQMAPSQSSSLQSRFNQVMSHCYHNSDFMGAHYWWNASRQLRRSIADVPSRLGDDSWILEPMHTACSRSLRVAHSVIERCEADFVALDRSLWQLQGTVKEMVKTITKLRNKMWYMTDVKNSMRYEDARNVPLALKTMVYSARLHQPISTSDRRTRSSPRALGGSVLQKPELQVMNVMKAPSSQGGPNKLSDEQVELTRKWLAQNNIDNFCKGEERIHRFCYEVKVSINRLVGDTMAEAPVLWASELFQKERVKFEGSSNRSFLGLSSSSLRPMSTAGEELSFASQSSGGSLRSSDCFSIYTQYLPPLNRKSSFQSSISDKWRMPRDPSPADGLSIGDSPSKATSESTADTYSTFWSVPHQNAPYAASASSFYSRPPSMLSETVVQPAPQKDFKGQGKAAFLDELKQALTSLLLSDLGSPVWSCGSETDAWFGNALDQERIRVQMKKREKIQCFYAECNARTVRQIPRHYQSRGRRSRSLGPPLSGRAQESDDTTSVPMSESARAAEDQSPFSYGVVFRQLIEIFSRHGNPFVKLNALRDLRALVIASLNVDNDKAYAHAVQERTHSRELGLHGKRAARHSFSEVGTLRGAEKGFLQTPTSPAAESVTLDSRPSEYSAPTENQIVDALRSLLLEVKPKTLFRDLQFISAFVPSETLNKTDSGTAFLQFGLAALSLKEEVCNSMVEIADRIVSQELSRRHVPQPFGFNARPSHAIEDAAGMWIITAKEGNPVAQRELAILYLTHPELLPRVTLPLTSPRDTFKAEMMYRRDKDSKSDPQSMCLALHWMQLSANGGDQLARNRLREREEFDSIA

SEQ ID NO: 42580 - protein, 233 aa, A.fumigatus
PSYYFMSVTMADQQPEKTTAPASDVADSQPAVVSNTDTRKETTETAEPQSEDKTATTTAQPAVETTATQSGTAETPAEADKAPAEVQQPPQAEEEKPVAQQPEQPAYLAKNPALSQFFERLPAIVSSSGHAEMWGVPLKDSNDAPTVNVLIKFLRANEGNVKLAEEQLTKALKWRKETNPSALAESTSYSATKFGGLGYLTTYKEANGAETVVTWNIYGGVKDINTTFGDMNE

SEQ ID NO: 42581 - protein, 203 aa, A.fumigatus
SLFYTCRFVKWRVALMELAVKELKMAEATSVIDYDGEDPYQMIQVHDYQNVSFLRLNPAIKAATKKTIEVFTTAYPELLREKFFVNVPAIMGWMFAAMKVFLSKNTTRKFHPISNGANLAREFPSLKDQFPKVYGGSAPALQEGARTVSLIQDESAPAATEQSKEQANKEEAAQEESKPESAPEQPKADPDVIVQEAPAADAK

SEQ ID NO: 42582 - protein, 60 aa, A.fumigatus
LSAYFPYDGSSLSLIDSFTLFLDSCITLAQRLSDHHSSYNRDKIPKLPRVHRFVLLAAFA

SEQ ID NO: 42583 - protein, 533 aa, A.fumigatus
HAKVSPLVQTLPLIIVFFLFYFEALISDFDLTNIPISDLLPLSSQATATCNTASRAQDSPSVPQPSTAPTPSMSPMLLVPDDGSVDRSSVSQVDLTIGESEDSGRSSAQFIAAPMRSDSRQAMDLPPPPTTTPTLPSISTEPPKVSFEDFAIRYRQNQHKQARRITLENRLHATKISIGISTRLVRVGGVVQRGLVESLKHEDKANFLALYHTFLDLQDSHDLAMRHHFYRQDPSEDWSSAQESTVERSPDFFLQLSPQSRSDLLRILQLVRTNPQFLCDRLCSLTSAQLNALLSTSTTSLDSGDHTFLPAARSRNQYSLPKRASAASVPFRDHAVNFERTDAISNLVFNVFATPLDSDTPEARLRLDVWSSVCSELITQGGNRFYPLIGHILSSWTMGSAWQARPKFELYLMDILQTGAFLLEHIETPAGLGFDAGSLDPLKTDVAEEYFASAVDALFKLLDDPDASFPHTVFKFARAILQKLGSPDSRARFLEYLLLQWFFPKFLSGALAYPEVCSSPSSNVMISGLGEGN

SEQ ID NO: 42584 - protein, 206 aa, A.fumigatus
IGNLSHLYLPSRDAACDSCLSSCINLRISLSFSPTHQPKGSLLEQDILSIVILALPDLPIISCQSPWPTNSPKRLLLLLLMSQTRSLPSFPTLTPARRQPRLRSHNQRTRPQPQPRNLPLKPLPPNPAPQRLPLRPTRLPPKCSNRPRPKRRSLSLSSRNSQPILPKTLPSHSSSSVSLPLSPAAAMQKCGVSPSRTRTMLPLSTF

SEQ ID NO: 42585 - protein, 72 aa, A.fumigatus
LFRETIKWGLWCIKDARDVPESWPFEPIEFSLWILYDKVSTTYSYMNDVLRITISEDNYIYNIIMSIIIFLQ

SEQ ID NO: 42586 - protein, 142 aa, A.fumigatus
FITSNMICAVAGMTADANILINYARQAAQRYLLTYGEEIPCEQLVRRLCDLKQGYTQHGGLRPFGVSFIYAGYDPLREFQLYQSNPSGNYGGWNATSVRANNASAQSLLKQDYKEDCDLKEACAHAPSGLKAGQWDPTKLEP

SEQ ID NO: 42587 - protein, 167 aa, A.fumigatus
IIGQSTNLRFSLKQADGNLLTADQLIGTGGGSRNAQLQITDPKVCRSYLVGTCPHDLFTNTKQDLGPCPKVHSEGLKTEYETASAAEKAKWGFEFDYMRDMQKYIDDCDRRIDSAQRRLEKTPDEIRQTNNLVRAKHFHRAIGRIFADSHTAETNLRPHKDYQYWSP

SEQ ID NO: 42588 - protein, 293 aa, A.fumigatus
QNFVDLTEALPGFYCTHFPLVSLSIGMADVRSLLRSELAARKGAPQAGTTGNRVTKKRKVDITDDLTRKKIKPGEKSADPLSPTVHTVQPPSAQAIDGVDDVEQRARETASLELPPDSKASQKQTQAQSEPLLESNTPQAIDEDEWAAFERDVVAPTRVPQAPAAVAAAATISAAPMSAEQLAAQQEAEKGTSIQAREAEIEGEREDAARFLEDEFDEMEQLEERIRRLKHKREELRRKRAKEASEIPQAEGSSGKTQGEQQIDETRQSDEEENDDDDDDDADDDDWDNWRFR

SEQ ID NO: 42589 - protein, 139 aa, A.fumigatus
SSSSSLSVTSTSSYSSLSSIACAAVPGSCTLPGSSEGRTSSNISLLFSPDFSASSERAFCSLFSLSKRSYSTTPFITAGGNFQKLSFVSGLWTNLLPSLVFTSTHGSHPGIACFDFGLSSGPRLLRSRNPFPPRNPPLE

SEQ ID NO: 42590 - protein, 172 aa, A.fumigatus
GRSTSIELSVEYSLTLTQLKQISDLTKTINTGLLEVSVLGETGAVAQALNELHKIRTAKHQKETCERELKNLQDTSGPSGHQKLQVCDVCGAYLSRLDNDRRLADHFFGKMHMGYSDMRKTYKKLSEELKGRPPPVRHHDDDEGGWGGRSGGGRGPRYGGGGGGYRKRGGRW

SEQ ID NO: 42591 - protein, 80 aa, A.fumigatus
KLLQDPHNLTTTLSNKTLLILLKHSQDFIVLTFLLLVYPLEWQMFARYFEVSLLLGRAHRKQELPVIELPRSGRSISRMT

SEQ ID NO: 42592 - protein, 82 aa, A.fumigatus
TTIFSPEGRLYQVEYALEAISHAGTALGILAKDGIVLAAEKKVTSKLLEQDTSAEKLYTLNEYAFPNGEKLLISFTPLLIHH

SEQ ID NO: 42593 - protein, 594 aa, A.fumigatus
  UNSURE (102): Identity of amino acid sequences at the above locations are unknown.
WSECSNLPTLPLLHYHRGGQNIELLQVSFLTAIFRAQVTDYETGHLYYYNAETKQSTYTRPQPLPVQSQPAAPTQIPFVTPDTLPPFSSTPYAPEGFSFSDXARGLPHHGHSRGGFRGGKGFRDRNNRGPEDRPKSKHAIPGCEPWVLVKTRLGRRFVHNPETNESFWKFPPAVMKGVVEYDRLEREKREQKARSEEAEKSGENRREILDEVRPSEEPGSVQDPGTAAHAMEDSDEYEEVEVTDSEDEDDQPSKRPKTEDTNDQQQPLEFTEEDIEYQLAAMGEEYGLDPGEYGEPGQEGWEEGAEGLPLTEEDATALFRDLLDDYHINPYFTWEKIIEEGRIIEDSRYTVLPNMKARREAWSSWSRDRIQQLKEQKEKQEKKDPRIRYLAFLQEHATPKLYWPEFKRKYRKEPEMKDSQLSDKDREKLYRDLASRLKLPESTRKSDFSALLKSVPLQELNRSSNLEALPSSIITDLRYISLPPKVRDPLLEAYISTLPPAPEQDMTADQLEALNRNRLEREKRERALAEREKRVQEEKRKQQSDLVRGRHLLREGEAEIQEAMRVRKEGIRSYLEAENQDSVKVSQEKSPEAS

SEQ ID NO: 42594 - protein, 142 aa, A.fumigatus
SRSNLTRAWAPRDEPVLSAERTIVGHGQERGGMRIIFGNPSDAHPVDFIYFETLPWFLRPYVHTLRATITGRNGTTRSVPVSHIVKETFYRPAIDRERGTQLELALSVPAASIVTLTYDFEKPILRLLPQGGRGIRAMLMRK

SEQ ID NO: 42595 - protein, 907 aa, A.fumigatus
LLRSEEPRRSGRSTKGQHKNLDMVTETPAKKSKAKAQSKDKSEKPPKPSVEPTPAVSEEEEIIRCICGEYEEEEDIERDMICCDQCSAWQHNDCMGLTFAKGEEPDEYFCELCRPENHKVLLDKIARGEKPWEEAAEKRRQQAEEKKAARRRKGRKGGRKGRPSEPKPDTGTPARNKAASATPAQTPVPLAPPPVVTPVPEKNGDVSDAHPSSTQKRKFEVHQEAPASDTVRLDYYCLKIGTAAHVYQQGPKPKQIKMTSPADSVTPLNDKPAQAKEDSTAPPSRQSSVSEKTTTQESGTLDEISNPARRSAASALVKLFVDQISDAQKQGSFKLPEGRSAKEIAQQLGFSIEKAMYQNICGGSGEPTEPYKLQLRTILFNVKKNPSLRDRLLVGSLLPDALSKMSSQDMASEELLQKDAEIRREAERQHIIVEEQGPRIRRTHKGEEFIEDENQTVASEPVFSVVPTRRSLADVDASPSNQSPASPQAHQQPDDSAPRAAKPLPIDTKAKDTKARNGPTVHSPGAADHDQVFPEVSTHIHEMLPTGKAQADAEIDKLLKDVEPESPPYSPKDFNDEAIIWRGKVVMNPVAEFSSLAKHVGGAELSDKIPWSQLAPSTLVVDGRIDIQLASNYLCGLRFSSSTDVSVISISRPESPKDQKGFDKLFNYFQDRKRYGVVGKHPLPAVKDTYVIPIEAGSTKKPEFIELLENNTLEDPTPERVLLVVFAVKTGESNPPSVQLSSHHPSQEPASFASPVTVAATPQQQQFLTPGPRQMSQMSPTTPPSAISGIIPTLNSFASQPPQSLQPQQPQLPTQPASQSQGYQPPQPHSQMAVTGMAAAVKVLGAQANAPAIQQLLQQAPNADVSQLGVVHGIISRQPEAASNYEMLMQALYQATTNGHGPQQNAS

SEQ ID NO: 42596 - protein, 63 aa, A.fumigatus
ITHVHLAEEVIGQAAIVIKTTQIGSADVANLQLLMTGWTGGILEILEFALTGLFLVFGGTNLV

SEQ ID NO: 42597 - protein, 143 aa, A.fumigatus
  UNSURE (91): Identity of amino acid sequences at the above locations are unknown.
ERSRSYRNRNSKLLDCKNDVMVVRSFFPLLSLLIALATFTSASSDYHEAFVLQPLPQSSLLASFNFRGNTSQEAFNQRHFRYFPRALGQIXQHTHTKELHIRFTTGRWDAESWGTRPWNGTKEGNTGVELWAWIDAPDSERWV

SEQ ID NO: 42598 - protein, 140 aa, A.fumigatus
FSSSAFARWISLTQSLSGLFCASLNFIDSTRTTRPVVSFEPTGNHYPSSDLHLLHGTLPGEVVCTENLTPFLKLLPCKGNAGVSSLLDGHKLFDASWQSMSVDVRPVCPQGGKCLMQIEQTVDIVLDIERSKRPRGELSK

SEQ ID NO: 42599 - protein, 316 aa, A.fumigatus
LILLRQLVRYLHDLHDGPAMNCPSRTDDTLKHPGWNQNPPALNADMTTRNDLNGIANSKVHRRHASGMGGVSGEGIMETDSQSHNQDCTESEIVETKTLGGVIAAASGYENPQSHRESPRRYTNLTTIITSHIIHVRQSLAKFARFVGPGFLIAVAYIDPGNYATDVAAGAEFRYALLFIVLLSNLFAIFLQSLCIKLGSVTGLNLAENCREHLPKWLVYILYFLSEAAIVATDIAEVWPAYSTVLSFPFRALTDLTSRSWVQLLLSTSFLKSRWLLDVPSRSPMFSSFSFSIDPTDPSGGCDFLNTLLWHWSWGW

SEQ ID NO: 42600 - protein, 297 aa, A.fumigatus
YSPKGEWIPVQAMLRPMVLTEAIFQSSLYQSCGILGATVMPHSIFLGSGVVQPRLKEFDVTKGYVDPAVCLGSTDGKVEYRPSIHAIRGCMKYSIIELSLSLFTFALFVNSSILIVAGASLYGSSGADNADLWGIHDLLSSSIAPVAGLIFALALLLSGISAGIVCTMAGQMVSEGMLKWTIRPWLRRLITRSISIIPSIIIAAAVGKDGLDKTLTASQVVLSVILPFVTAPLIYFTCRNRYMTVPADRVGGEEADNLSEGVKMRNNFLVSALALLIWLVIAVMNVALLVLVGLGKA

SEQ ID NO: 42601 - protein, 476 aa, A.fumigatus
HPSQWLKTQNLIPILLSFLTPEHPASVQTSAGDFLKAIITISANATQNDQSCIGPNSLTRQLVSAQCVETLITAMLQGGNPLTVGVGIVIEVIRKNNSDYDPETIGGPDSPPTTYDPIYLGNLLRIFAKHIPDFMALIRSSKHTISDNGKVRSVERGQLSSAWGAKIEPLGFDRFKTCELMAELLHCSNMGLLNEPGSDEYVRQRDAERERLFREGAFNPHKELSALEGNDSTTDFINGSVIDCGSPEDSRVIEILNAGEDGFEDVDSSGVLVDKEKLAERKESDSQQTEPVVGDKSRTSATTEDDVKHAGEANDHEEAKMDTKEEDSSDKDLPSTVSDLTDQLYAMDLGDQWASKGATAQEDIGKSETLPSNDSNTPSATQMPSNPEAVPEPLFSKTQQQKEPVTSTPDPADQAGNAQDSTDHGSTSVPSNTDAEDLRAHINSYVQLDPNGQPVVGDYLKIMFVKNQVVPTILVS

SEQ ID NO: 42602 - protein, 70 aa, A.fumigatus
LGTLLLCGHQGHSVAMHSFCGVILDLEANMLCLTSLQLISEIKASGLRGRGGAGFPSGLKYVSFPPCEIR

SEQ ID NO: 42603 - protein, 287 aa, A.fumigatus
SFMNFKDWDKDPRPRYLVVNADEGEPGTCKDREIMRKDPHKLIEGCLVVGRAMNATAAYIYIRGEFYHEATVLQRAINEAYQAGLIGKNACGTGYDFDVYIHRGMGAYICGEETSLIESIEGKAGKPRLKPPFPAAVGLFGCPSTVTNVETVAVCPTIMRRGASWFSSFGAERNSGTKLFCISGHVNNPCTVEEEMSIPLRELIDRHCGGVRGGWDNLLAVIPGGSSTPVIPKSVCDNQIMDFDSLKDSQSGLGTAAVIVMDKSTDIVRAISRLSKFYKHESCGQVF

SEQ ID NO: 42604 - protein, 250 aa, A.fumigatus
FMMFWRFGGYASVSTIDTLLDKPDVSLEELLDESELIQELKQHNTKLIEYLREDNVLKRLMDYVIAPSLVNEDDDDDEDDSNDSNAPQTNQDASTGGEKKVDPLKEILDPEDLDRAEKNRLKHAYIACEILSSETWSILESIMANRSYLRDFWGFVRRRPSLDPIQAGYFTKVNETLFDRKTSEMLEFFKSLEGIVPAILQHVDNPMVMDLLLKIISLEKAEGGQGIVDVCSSENNPLLSMVQTDTHHSG

SEQ ID NO: 42605 - protein, 239 aa, A.fumigatus
DFFFRFPWNNFLHNVVYDVVQQVFNGPMERGYNRCLAIDLFETGRITQAIVAGQKRSDEAQRTQRIRLGYMGHLTLIAEEVVKFSERHPPELLSPTVMESVLNPEWIDYVEQTLSETRERDNAILGGVRPDMAIGHRQGLLNQGQSMNTSSALAEAGLNGGISNSGFQNFDMNQGSVSGGAFGLGSGSSSLLSGFGSSSDDEDEEMDEQDDKNLTEQSAEGGSENVSDDLFTDVDMDDA

SEQ ID NO: 42606 - protein, 90 aa, A.fumigatus
VTQLSGHCSSPDDLTHADPLAPRIFIVDSISFAVTQATAHADVFMNLGIYELNESTYTNSSSTSCSPQPRTISRTTATGSTACRSETASC

SEQ ID NO: 42607 - protein, 152 aa, A.fumigatus
SSTTVIIPQLTFHLSPRDNPSIPRQFPATGPSTTMISRAAAPSPSSIANLSSRSLRIQGSAARSFASVQDTTHPVRQHGGLRDQDRIFTNLYGHHGTDLKSAMKFGDWHRTKDIVLKGHDWVRFSFAATKDILWPCTRFAGLYWTLRLICCA

SEQ ID NO: 42608 - protein, 73 aa, A.fumigatus
SPPSPPPLVCSAAPAPSPMLRPSPSALPSCAVEPAGSPRSAPSATLVQSCSVFPVTSTIPARSRRRCPSLCVS

SEQ ID NO: 42609 - protein, 91 aa, A.fumigatus
VVGSAIALNLLLKIPLVAGCAITLADVLFLLIFYRPNGSIWGLRLFEYFVMALVLGVVVCFCIQLSLIREQSVRDVFRGYLPSSAIVQSKG

SEQ ID NO: 42610 - protein, 172 aa, A.fumigatus
PRPPAGSLTLACSGGSSINCGGATSSCMKLGKELSPIALSNMDSSPNASNSASSSASSTSSGISYAREILSWISLPISIRSAISSCMRSILSMSTLPYCFFSSLVVVFIASTVVITFFKLSCIIPACSMFQDCWDSWSRWASYCFRRCRTLSAFWRSAFLPGPSRILAILAW

SEQ ID NO: 42611 - protein, 78 aa, A.fumigatus
PVSIIASATLSAFLFSVFVDSLQSSVSPLYWTLYDNSAEINSLLFFFFFFFFFFFFFFARSILSKFDIPRLTALGLKS

SEQ ID NO: 42612 - protein, 100 aa, A.fumigatus
CVNKTNDRDLYLWSSSILVSRAFSAKVLAEPVTDVELPEDGVSVLLPCIDLMNHRPLAKVEWRAGKQDVAFVVLEDVASGQEISNNYGPRNNEQCKSQVE

SEQ ID NO: 42613 - protein, 293 aa, A.fumigatus
EDLAATLMLVELGQTGDGADDVGGLVHDDNGGSPQTGLGVLEGVEIHDLVIADGLGDDGSGGATGDDGEEVVPAATHTTAVTVDQLTQRDGHLLLDRAGIVDVTGNTEQLCTRVALGAERGEPAGSTAHDGRADGDGLNIGDGAGAAEQTNGGGEGGLQARLAGLALDRLDERGLLTTDIGTHSAVDVNIEVVACAAGVLTDETSLVGFVDGPLEDGCFVVEFTTDVNVGGGGVHRTTDNEATLDQFVGILAHDLTVFACARFTFIGVDDQVSGSGILIPILEVHERLMQIRD

SEQ ID NO: 42614 - protein, 76 aa, A.fumigatus
IASKHIANGLFPDKRKLYTEAYYHPQDQCHNKVFKKSQPPDGSVGSIENEKEENIGERDGTSSNQRDFKKEVESNS

SEQ ID NO: 42615 - protein, 60 aa, A.fumigatus
PGASSRIFRRQHLVLIPHPYITPHCTHYPISYLTHTLKKDESTIWNKKHGSQANARRCYF

SEQ ID NO: 42616 - protein, 200 aa, A.fumigatus
HPAITKVDNRIASIDVKLASLNAELSTYQAKIAKMRDGPGKNALRQKALKVLQRRKQYEAQRDQLSQQSWNMEQAGMMQDNLKNVMTTVDAMKTTTKELKKQYGKVDIDKIERMQDEMADLMDIGNEIQESISRAYDIPEDVDEAELDAELEALGEESMFESAMGESSLPSFMQDEVAPPQFIDEPPEQAKVKEPAGGLG

SEQ ID NO: 42617 - protein, 266 aa, A.fumigatus
LDTIKLSEINAGRCPKLLHQLTVCSTDSGRVLIKLEMNHAIIDGGSVDLLLRDLAMAYKHQLPEGSGPHFSDYIKFVRGKSQSQALSHWRQYLSDAHPCHLTFSEGTGGSRQLGSVMVPFSRYSELQQFCEKNSVTLANLTLAAWAIVLQSFTGSNDVCFGYPSAGRDAPVPGIQDAVGIFLNMLCCRVRVLTRGRLCWRFQRQCKMTISRTFHTRIVPSQVFSMNLGKRSCLTRQSRFKTTTLSQKNLEMTCSLLMYRRRMTRQR

SEQ ID NO: 42618 - protein, 676 aa, A.fumigatus
  UNSURE (54): Identity of amino acid sequences at the above locations are unknown.
RCSALRAKTGLTLTMADVIKIPVLEDMLAAISASHSSSVLEPDFPADSNNERLXELPRLVELERNPPPPEISLLKTVPLNDSALQDGICPKIGVFKGGIADVLPVTDFQAMSITATLFKSRWMLNYFFFDGRGSLDLRRLRESLLRVVDAFDILRTVFVCFNGQFFQVVLRKIRPNIFVHETEKNLDEYTEYLQQQDREQEARQGEQYVKFYIVKKKGSNHHRILIRMSHAQFDGLCLPTIMSAIKLGYEGSTLPPAPSFANYMRMLSGAITPDHYQHWTNLLKGSKMTQVIRRTEENTYRYIGAFREQRKTLEIQPSVLENVTIATVMQAAWAVTLAKLSAQSDVVFGLTISGRNTSIPGIENTVGPCLNVIPIRVTFKEGWTGVDLFRYLQDQQIANMPFEALGFTEIIRRCTDWPSSTYFTTSVFHQNVEYEGQMQLDNTTYRMGGAGVVDNFTDMTLFSKSSSDGKLGVSLGYSDKGPIGPKFAAKVLSMVCDTVQSLLANSRVGLPSPSMLRSLPCQSVHDVPGMTDEMFLSTHLKDRSISDILVHSDVVTQAWQQVLPRNNADEPQSSFQLDSSFFELGGDVFDMAQVVWLLEQEGLQVHIEDLLEHPTFLGQMAVLTLHNSRTSDSMEEIVPVDEIPLPAARTGTSSSLGKALTLAKKVTRWSALSARG

SEQ ID NO: 42619 - protein, 71 aa, A.fumigatus
SLVLIIFLYYFGVHILWSYTFSLSWIFYSHARDGFGHSVYIGGLAAGLNFILFTCFANMHCLMNLVCNYIY

SEQ ID NO: 42620 - protein, 98 aa, A.fumigatus
PDYLSLCLIFIGFFSRQGNTSTQSLSPNRFHSSSHNAAMSNTTQTKDKPETSEQSTQQKPTVLEEDDEFEDFPVEGEHLSNPAHGEAGHSPNIITSYF

SEQ ID NO: 42621 - protein, 105 aa, A.fumigatus
FDSGQYSVVYLLDRAATSGSSLHSRSSSEAPPPVETWLSFSSAPYLAATVAVSPPPMITMAPFLAASTAASRVCLVPLAKGSISKTPGGPFQEDVFSPAGWKIRV

SEQ ID NO: 42622 - protein, 157 aa, A.fumigatus
GKSCSHGGVADEPTNPLIQCVDLNSWSRSLYYYIAGSCHLSLYRDVKETDSAKAAKHAELAEKYFRMAPTVAGKKRFMARQLPFDVFVARKFAKWEARAKEWKVSLVDAVGVDPIEEMIFFWNGHSRMTDEQLQESLQKLAWSESSANTTWSREGPE

SEQ ID NO: 42623 - protein, 152 aa, A.fumigatus
IGHLAVAIACCFYEVMTDNDHFSRTSSTSTTGSDIDSQSEQNGFDQGHREPNNSALEKQTTAASGLSVLEQRAQSVISRIRSREPGQTARFTHPLSHSKTSEDVIVDFDGPDDPYRPLNWGFRKKAVTTVLYGLTTMGMRRPLSEMQTTREG

SEQ ID NO: 42624 - protein, 171 aa, A.fumigatus
RQLFHGHHSSFQAFRRWRGSWHTWDNLTTIWFWYVIVTAIYEDGKVCLLAFPGLGPLVFAPLSEVYGRKSAVLIPYFIAAIFSFGTATAKDLQTVMITRFFTGFFGSAPVTNTGGVLGDIWSAEQRGAAIVGYAMAVVGGPVLGPIVGGAIIQSYLGWRWTQYVSEAHTAW

SEQ ID NO: 42625 - protein, 298 aa, A.fumigatus
ATANTGVQSKITGIMMMFFLVMDVIFLDESYAPVLLVYKARRLRYETGNWALHARHEEWDVTLKELGNKYLVRPFQLLATPICFLVALYASFVYGILYLSLASFPVEFQEVRGWSPVVGALPFLAYLIGILFGAALNLFNQRFYIERFKANNNFPVPEARLPPMMVGSVFFAAGLFIFGWTGAKNIHWIGPNAGAVSMGFGFFTIFQAALNYLIDTFQQYAASAVAANTFLRSLFAGCFPLFAGIMFRKMGVNWAASTLGFVAVALIPIPYLFYIYGRRIRARGKWSQASVYGPVRGR

SEQ ID NO: 42626 - protein, 401 aa, A.fumigatus
SLSPVLDCSQLQSGLSITDALVASERLNEAETSASVDQHRAQHNSYAPNTYHSPMYLPGTEFALCQAIAQLMSAIVGVLNESLTESIKAFYRLRKAYITLDAILKMEQKYMEESRAATLVESTTSGSVPSSLRHSSSNLHSSSSSISSAKGKEAAADTLAAPSNDTDVQERLADLSLSGEPAVAEDPGQTPTPINTDILDHDPDSDIFQNQIDVFVHSGSNFCFGVLLLLISMVPPSFSKLLSIIGFHGDKERGLKMLWQASKFHNLIGGIAAFAILGYYNGFVRYCDIMPDSIPGKDGDVQGYPQKRLELLLANMTERFPKSQLWLLEESRMSGANKNLDRALELLCGEERSPLKQVEALRVFERSLNAMYLHKYELCADSFLEVRAAHMEESQTSPLTH

SEQ ID NO: 42627 - protein, 89 aa, A.fumigatus
VILGEGCRRVGQISFTMHTSRLYCNFSRLGPGRALELALSIVSCRYGQSSFLEHLTDYFSDTAIDKFLKGLAVNELTALHQLSPTEVQL

SEQ ID NO: 42628 - protein, 95 aa, A.fumigatus
TLIFQPAGLNTSSWNGPPGVFEMEPFANGTKQTLDAAVDAAKNGAIVIIGGGDTATVAAKYGAEEKLSHVSTGGGASLELLECKELPDVAALSSK

SEQ ID NO: 42629 - protein, 185 aa, A.fumigatus
KLSHTLLSRYEDSEVGESEEEGSEEEEEFEEDEGEGEEEEEEEEEPSKDKGISISISTLLCPYSILFATNVLHHQLLPPSEERQPLRARPRRMATVFLPKTRMKKKKKKKKKKKKKKKKKKKKKTEKASQRMKSLRTPPKPALLLQQRPRLRGALVPRRPRLKLGRRMRSNLLSFCCNRLLVSRY

SEQ ID NO: 42630 - protein, 180 aa, A.fumigatus
PMKTKQYIQVYSVAWLLDFLVPTLFGTMLVLVVWPQSRKVLFPPAPLALVDKSTGGVQKPKAGVLGSHDSVTGAPEKYKGEAAEQEASNLIASVATVAVGSAAGKHDQGTPENAPMESSVPDAMDIVSKTADAQAAAGGEVPADTHDKTRQPMKETVLNGANLAMRVLSDIIDTYERFGK

SEQ ID NO: 42631 - protein, 79 aa, A.fumigatus
PQLGRGRIFVPPTSPIIPPRPFTRTSSTHLLFFMLMQNLNVNNSRIIDHHTHAHRSPHFRQLIAGLQIASQRRLVALLA

SEQ ID NO: 42632 - protein, 259 aa, A.fumigatus
GFTTLRLISGVSSGNHDQVSQYAISPRALSNHRGAADSPYVRTYPSKGVVLHYHFAKFQLNSLSLRALSPSNTPVFSMDRKESANIAISSAMACLNMVLEEQDIRDAIVGVPIFTHTMVTFSAVFLLKVAVNWNSAYLSIDGRQVRRLVERVIELLNCVSAGERHLTRHIARGLSKMLERFDSWETAWQAGRPANAGGLPVGGTGAVDRPEGEVPGGANAMAQGFPPPDLIYDMVGTYGFGLDENLLDPSMANFEFLAQ

SEQ ID NO: 42633 - protein, 100 aa, A.fumigatus
RSSPPAPPSKRRKTAPEGEAKENGNGVPAKDEDEEEEEEEEEEEEEEEEEEEEEDGEGEPEDEEPADTAKTSTPAAAATKAKGSAGPAEAEVEVGEENEK

SEQ ID NO: 42634 - protein, 326 aa, A.fumigatus
LDQTSSLNMQILITGAAGFIGQLLAKELLNDPSYHLTLTDIHEPPIPKGVKYPQNVKIIKADLLAGAESVVDKSLDAVFAFHGIMSSGSEANFDLGMSVNVDATRTLLEALRRTCPGVRFIYSSSQAVYGRPLPDVVDDSVTPTPQGSYGAEKLICETLVNEYTRRGFITGFTLRFPTISVRPGQPTAAASSFLSGMIREPLAGKECVIPVEDRSFKSWLCSPRTLAQNLVLTLSLPSDALPPHIRSINVPGICVTVQEMMDALEKVGGKDKLALLKEKEDPTLRPILDSWPTRFDNSQAIALGFKRDSSFEQAVQDYYEQEVLGR

SEQ ID NO: 42635 - protein, 405 aa, A.fumigatus
HSRLQKIKRDSCYSALFSDKISGINSPLFSCFCSPFSLSLLTLLHINNLLFLVRIFSLSSINNIFAHTSLLVTTCQASVTMKFSTFALGMFAGMAASAAIPASVVDGMNLSDNGLGTFLPLAFCLIPIESLSSSFQPSNQSSHPTNIFFSPTSIGLVNAGDPVCHKNSDCGPGIGYCYKGICVADPPKVERDDPICHKNSDCGPGVGYCYKGICVADPPKLTRDDASIVTCHTNKDCFNGLCIAGICHWGIGESSASNTANQNSASLVQTSEPADPVCHKNSDCGPGVGYCYHGICLADPPKLTSRDDPICHKNSDCGPGVGYCYHGICVADPPKDAREVSADPVCHKNSDCGPGVGYCYHGICVAGPPVVPRGEEADPVCHKDSDCGPGVGYCYHGICLAEPPK

SEQ ID NO: 42636 - protein, 219 aa, A.fumigatus
EELTRCTVMYLPLRILWKTKMNLHQKLGLATVFCLGFVIIAAAIIRAVAITGKAYSDQAALAIWGIAESSICMYYIQRRLVQPTLTCKAMIVGCLPPFKSFITSGSSSANYNYNYNYNSSQRAANHYNRSASSARIKKRSITTTSWSGLPIPLQERNLNAYQNLEYESQGKHDVHIAGGVNTRAAPPPEPSRLSLSEDDAGHGEIRMVKEFVRIFLFSF

SEQ ID NO: 42637 - protein, 275 aa, A.fumigatus
ALSTLVILFATKILTAVPALVTVTRASVLPTPPRLNATIPSATRTPTAVLVWVTATRESVSPTLPSSLEMMLLSLLAILTKIASTVFALLVFAIGALERVPPQTLRTRILPPLFRLLNLRIPFATRTPTVVLALVTAIMAFVLRTLPSSPLVTTPSATRTPTAVQVLVTVTMASVSLTLPRMLVKCRPTPSATRTPTVVPVWVTAIMASVSLVLPLFLAAKKPILCATRTPIAVQVLATATMAFALLSLPSEEFCWLTGSKWLLLVSFLLFSSLT

SEQ ID NO: 42638 - protein, 61 aa, A.fumigatus
LSVISLISYLTINGKDSISLLFCDNRLIVLTIKIMICAVSSKTNVKIQMASSLHGGQLQHR

SEQ ID NO: 42639 - protein, 95 aa, A.fumigatus
MRRPMTWHDLQWGNCGLSTAPSMLASSKRSRFKTAPPSQFSLPLSLLIITYTHTFVLTQWIKSATMVVKTFFDITIDGRKFPCGSILSVRVRDML

SEQ ID NO: 42640 - protein, 100 aa, A.fumigatus
YPGKVCVCSRCASAETADETRSEGYGALQIWIKYIQKGITYQESYKASDGCGKSHWVGAAFTVAGGYVWQDVYAEVFKRNLTIVGGGDPVRRSGFHLSSV

SEQ ID NO: 42641 - protein, 102 aa, A.fumigatus
GTCCDSNHSLEPAGRITFKLFDEVVPKTVENFRALCTGEKGFGYKGSSFHRIIPQFMLQGGDFTKGNVSSIVKPTLAPLQRENPLWSILICTLGHWWQVHLR

SEQ ID NO: 42642 - protein, 212 aa, A.fumigatus
ADLSKAPGDSCWPSIDTWNALNSSVSGKLILDTPPAISCYPGPYQNAEQCAYVNSQWYNSTFQSLSPVGYVYPTDDSCPPVDLSSGETPGKCTLGQAPVYTINATEPEELATGIAFAKKNNVRLVVRNTGHDILGKYVSVPAAPLRKRLTKQGRRDMELSKSGSSTFRRVSRTRKATKRRMGVARVTGLVLPLPSLEVTSGKTCMPKSSSAT

SEQ ID NO: 42643 - protein, 314 aa, A.fumigatus
TVGVIGGYAQGGGHSPASRDYGLGADQILEAQVVLADGSIVTANACQNSDLYFAIRGGGGGTYGVAISMTLKAYPTLPVVAQSLTITPLTSNTDPLLDAITDIYGQYPALSDAGYSGYGTWSINGPMALFGNQTIGYVHAIATMGKSLSASQAAFAPLLSKLQKYNGTSLFITVNYYQFPSYAAYYTAMSGMHQPVGSANSALTSRMFDKSALTVNPSILRSMIGAIAGKPEEYTINSLEMVGGGKVLTDGSDPYSGVNPAWRSTYIVNVVARGWPEGADAATAQAVKDDITYIKGGAMRLLTPFLGSYMNEVR

SEQ ID NO: 42644 - protein, 63 aa, A.fumigatus
QADRNDPLWATDFFGTNYIRLALIKKKYDPEGVFYCPKCVGSMTYYQKNLDGLDYGPLCSIGF

SEQ ID NO: 42645 - protein, 60 aa, A.fumigatus
HNSNGSQFFITTVVTSWLDGAHVVFGEVEDGMDLVKKIESYGSASGTPKKKITIADCGQL

SEQ ID NO: 42646 - protein, 263 aa, A.fumigatus
SLSDAILPVRSVHSHQHSVRAIAAHGDTLVSGSYDCTVRVWKISTGETIHRLQGHTLKVYSVVLDHKRNRCISGSMDNTVKVWSLDTGSIIYNLEGHSSLVGLLDLKCDRLVSAAADSTLRIWDPETGQCKSRLSAHTGAITCFQHDGQKVISGSDRTLKMWDVRNGECVRDLLTDLSGVWQVKFNDRRCVAAVQRDALTYIEVSRGSVCQSATIIINHLQVLDFGASRDGVPEDQLGRRIVVNRWGQEIGDNADEDYDLSDG

SEQ ID NO: 42647 - protein, 60 aa, A.fumigatus
PFTLFWFLIPEEGENSFRIAPNMINAVLVFNNNGQPRLTKFYTQIVSGLDVAVPREIGRK

SEQ ID NO: 42648 - protein, 79 aa, A.fumigatus
QTPEPSHRAPPPQLRYWPGRPAQAQPLPLRQVARVCPPSAPEEDSEPPPEGPPCHCSVPEHSGPQHRCPDLQAPQQVPP

SEQ ID NO: 42649 - protein, 62 aa, A.fumigatus
NVLHRHKSIIAYLASVNLTESSAALRAELGDSVSIDDATLKKYEGLLEKKWIFTTEAGRYRA

SEQ ID NO: 42650 - protein, 89 aa, A.fumigatus
LSTDGDRRSVTMLTKITIYLTADAIDSDYWARQCFASWHGSEHFGHQISNVCHFYSFHLPYFLFLSAPQAMKCLDTLYPQTCYLSRGFA

SEQ ID NO: 42651 - protein, 162 aa, A.fumigatus
DTQTKQSLIAQIYDLVAQRPPSACNFLPLPPLLSQGARSSAANGPSDAPTQVTYRTYATLSFIMISTSTESPLALIDLIQVFVEALDRIFENVCELDLIFGFETMHAVLSEMIVGGVVVETNIDKIVAGVREQEGNLGKKKAIQAASSGLGRGGLSGLGAWR

SEQ ID NO: 42652 - protein, 191 aa, A.fumigatus
GMQSFLKFLERIGFANKLQNPLIERRPRNFGIGQDVQPKRNLSRFVKWPEYVRLQRQKKILNLRLKVPPAIAQFQNTLDRNTAAQTFKLLNKYRPETKAEKKERLHAEATAVAEGKKKEDVSKKPYHVKYGLNHVVGLVENKKASLVLIAHDVDPIELVVFLPALCRKMGVPYAIVKGKARLGTVVHKKVR

SEQ ID NO: 42653 - protein, 74 aa, A.fumigatus
RTLMSHFQTAAVLALTEVRAEDKAEFSKLLSTIKEGYTDKYEESRRHWGGGIMGSKAVARMEKKRKAAEAAVRV

SEQ ID NO: 42654 - protein, 218 aa, A.fumigatus
GFIARSPIIFIKVPKISAPPARLTSVDSVSNFVAASAMAFTSAFDGTSLVVRRQRIRNFRVSCFTCGFLCLRNSRISSRQSDKFVDAKTASKACPRASATVCFFSFNRSMIGGMMVDRCFANAPRRPFARRSIQLAATVTTATFASFMDFARLRTISSNGPSLIRGTFSAVYRASSVSFLSFHFDDASCSLKSFGILGKTSTGSARSNASTSPSSSSA

SEQ ID NO: 42655 - protein, 171 aa, A.fumigatus
SIFKDGASESLLFIDDGQLVLTLAAACRLRRAFILIDSLHGIKKTDEDILMLFRKYAIPHQIILSKVDKVLAKRKKQVKSGASVANVAALRSLLQDLRPIVQPDGRDEGPGALGEILTCSAETPTGPGQFLGISAIRWAILSAAGFDGTVEVKAESIPSSSSIRGASAAPP

SEQ ID NO: 42656 - protein, 74 aa, A.fumigatus
NWKVRKEGYEDAKQQFEKTPDESDPVFVPFLQDPGLWKGAVSDSNVAAQQEGLASYCSFLKYGGVQACTRYVYP

SEQ ID NO: 42657 - protein, 831 aa, A.fumigatus
QGLRRTRGSTIGPIVEKGLPSTRPAAKANALEALLLCVELDKADPIIEEIVPILSHKVPKVIAAALSGLKAIYHSFGCKIVDPKPVLKALPKVFGHADKNVRVEAQNLTVELYRWLKEAIKPLFWGELKPVQQQDLEKLFESVKQEPAPKQERLTKAQQDAMAAANAAPESGDGDAEAGEVYADEDDGEVDAFDLAEPVDVFPKIPKDFNEQLASSKWKDRKETLDALYTALNVPRIKDGPFDDIVRSLAKSMKDANVAVVTVAANCIDLLAKGLRGAFAKHRSTIMPPIMERLKEKKQTVADALGQALDAVFASTNLSDCLEEILEFLKHKNPQVKQETLKFLIRCLRTTRDVPSKAEVKAIADAATKLLTESTEVNRAGGAEILGTLMKIMGERAMNPYLDGLDDIRKTKIKEFYEIAEVKAKDRPKPIVGPPKTVPAAGKKVVGGKKPALGMKKPAPAAAAPPPEEPAPTLSPPKPATKSIPSKLGGVPKPGGLPTPGAGLKLQRKLGGPGGLASPQRRVISPPSEEQPPAPAAPKFGLGRGLAGRPITKPSAAPEPAPAPAAPPQVSGISAIERAELDELRLERERFLRMIEDLKSERTRLNSQVTELQDQNAQLIEDHTRDVLSIKAKETQLVRARSDAEAAEQTVQKQQREIDRLKRELARALRASAQSPPNGFSDNMSFPVPETSIYYETGINGYNAIPRTGLHMGSRFDGGRPRSYVAASPSEEKENTDLESPGRGSRDGGLGRRKLSPSFGTNYSGMGSPTRSSIPGSGSASGEEQPMRSSEPAENWKRAAEVTSQLKARIEQMKVHPYSLFTCGHVSDRSY

SEQ ID NO: 42658 - protein, 199 aa, A.fumigatus
CTLQDMNNGDCLSYLLVDNGTETSLALDNGIGDTHLAAESGKEDNQLNRVNVVGDENKGSLLVLDEADNVVETVLDVVGLLGDILLLLALGNSGSLSVETLLLLGLGLRAVLVEELEGLGSGVAVQSVLELSNGRGDLQAEVQNLLLALKADILGPLDEAGEVALGLDVLANTEVAGAALDERVLEFVSETNSFQKFEE

SEQ ID NO: 42659 - protein, 220 aa, A.fumigatus
CSGAVSAETPLHLRPDHFLIQRHHDTFWLARSHLTDKKSYIKMKTRLYVCTACMRRNFSTALTLRDSPTAVAPSNPPNAPKLQLRDLTPSDLSYYWDTRIPNESQLSYADKFFTPSRHSPVKLWSASKFRTTPLSSLEPEVAFLGRSNVGKSSLLNAIMGKEMCWTSSKPGRTREMNAFGIGGTKGGESKIVLLDMPGYGKGSRTEWGIEILKYLQGRRQ

SEQ ID NO: 42660 - protein, 509 aa, A.fumigatus
EGWGESPSSPRSPSRPPSIRHRRSMQHLQELEARLDQLISENRLLIAAREAAEDKLRNASVARRKSDHTLNERSADLRDREAEVEKLKKSVEWLQKEVTRLTEENEGLITTNSNLTAAHAKEIESVRESSSRQLDDLRSRYEQLSMEVQNTVRHEIETALARKDNELRRLREELETARDKVSQLQQKIAASLHDNVLVFRDEDYFDAACQKLCGHVQQWVLRFSKHSDHRRCRKLAEIQDEKIADRFDNAILDGYDTDTYLADRVRRRDIFMSVVMTMVWEFVFTRYLFGMDREQRQKLKSLEKQLNEVGPRSAVHRWRAITLTLLSKRPAFARQRESDTEAVALEIFETLSRLLPPPSHVEVQLLESLRKVLRVAVNLSIEMRTQLAEYIMLPPLQPEYDTNGDLARQVYFNASLMNERSGETTSNEELESQQAVVRVVLFPLVVKKGNDTGEGEDEVVVCPAQVLVARPDKDPRASKIFSSDRMSLDGTKSVHSVAPSSTMDISNVI

SEQ ID NO: 42661 - protein, 125 aa, A.fumigatus
LTMASGKSSRSNSSQTETAAATGAYPSAGGYETPAPHTHHDAASEGRSVTNKPKRRKNRHRKRRNRRQSFLAPEESHNGAAASGADADAMIAGDQPYSRPALPFYNLGRDLSSTSLESEALLDHR

SEQ ID NO: 42662 - protein, 88 aa, A.fumigatus
AVQAWRVRLCWTIGRFSFGLGGIASLSFALLMMRLLKSMQKSTHHATSERKPTGTVLSTWVYDDSVSFYRFSFSWYTLRYQGLSGRRR

SEQ ID NO: 42663 - protein, 289 aa, A.fumigatus
GAAPSSPVVKTTEPHGGDDEDLTWTDHMVSSQVEQQQGTPSDRPSEPAPETEPISTREAATSIDVEQLDNNAHDASPAVNDRLERSGEERTRVKKEIVSEEPEVQYEGLLGIPREEKAEISSQGEDTIQVKSDAEVEESVKATVEGTPEDSMSQEDAPISVLDGGDATTKDQFTSIEVNDPSQSKDILEPENEELPLPIPGKKKKAQQETKIDETSQDDSVDAVQEESPTSREMTDTGLPVAESQADPIAEPFHELPEPQKAVEIAVEDKSMQETLKFKQDVTPAEDVF

SEQ ID NO: 42664 - protein, 948 aa, A.fumigatus
  UNSURE (238),(269): Identity of amino acid sequences at the above locations are unknown.
EPPALGRKKSKKDKKKDLLAQNTAVESRENKFKEKQLATEEPLITPSDARTTVLATPVFTQALETPTKTTVDAGERELHLSAVQSTVPVEDNINALETSGAQTLESFRTLEAPEQPLERNILLNDYAAKTPEELPAVEKSATYETATEPIIEEAALSHKNSKKKSKKAKKQAQEQQEKSTTPTPAEHGEESIVETTAAIPSTPGPAENSDDIPEANISEEQVAQLEHSEQLVLSDAAXPQERLGQTPNMDNQTDDVQSTEQGKEGNVQXEPRQVESEDPIESQPGSTAAVARKLSKKDRRKAKKKSAKDAIEPSDEPELRNPTEPIGASCSTSNQAKIDQDQFLTVASDKQMVEEVPRPLEVEPAASEVYQGATDENDWPAIDWEKGKVEFKEQTPLSSPEAHAVLFEPAIAEFDETAIPEGLLRRQSLSREEQLAGGKDGSSQHTRADEIAAPQEGAVMIEPSAVAETEQSAGLQAKSVSSQGAPKTIQDDMQHPENRLARDQTKSETGVVPSKQSKIGSIFPDLERGSFRRPVPGQVLMPVKDRAEDETIDQNADDNSAIKVSEAPIPAGEPEESHLQSQQDEKGPEPTTTVSTLDLSLEEPTKMQDTSNTPVNLAVDIEVDPSYNVSVISDGLVNETKSIEIEWKTDGDKGTQEAETPLYAPLPVHEQKSSLVSQASPLDMDRDEPIPRNDSSCGLRRSPSIHGRHNHPPRTWSLEDTPITKAVTPPLFGGPVGATADMSSPPRTPLQPIAEQEPEVRVEQASGFRSMVSEHGTPRLEMKPEHVLPRPETPIRKFTDNALARQTWPVAENDIFKSSEDEDAALTVKKQRPGNKWPAEVLKTPDKGMPILRPSSVSSVKSVQSTHSVTGGQRSLRRTSRNTSGDLRAASQAQESHGTQPHATPQPPQPPPSDLNIEHIASSSSYDPVTDKGKRPIRAMTDVYVSVY

SEQ ID NO: 42665 - protein, 672 aa, A.fumigatus
CASLNLCRNQPTMRPRRESRLAQSFRPGSMTIPSRSIDLASRGTPSGTRVFQAGDDSDGSDGADDHTPLIRPASGHHNNKSWYGTDAKASPFASRQRRTSVQSASSRCSPRGLATPDPDRDYDINNPPSIPSSPKLGGEMNYDDAVVTGADFDFALAKSIDNRNQAGSRPNDMVIDVDGRSTQQKPSTQSSPVSPHLSPHEALRRRRTVALPVEEDVCFPIEEASELAEEDARRTSREDGRRRRRTKEWPDLSVLEEWSREEKEERNGVLRAKKISEPVLIEGRLRPQYRVWRREEDEAPYRFTYFNEEFQSTIHAQSISELVQPGGSFRELFIPDPPELEDSSDEEDFEDENNHSDPVTDSNHDGQDNARAEDHRPAQAGGHNVNAANGPKAQHNTSIISEGMSEARASVEASPARKVSTPKPKKFGPRPTFWLDVLSPTDAEMRVIAKAFGIHALTAEDIMMQEAREKVELFRSYYFVNYRTFEQDPNSENYLQPVNMYIVVFREGILSFHFSQTPHPANVRRRIRQLMDYLILSSDWISYALIDDITDVFGPLIQSIEDEVDEIDERIMKMHSPGRIDTSVNPANRREDGDDVPEPPAPGEMLRRVGECRKKVMGMYRLLSNKADVVKGFAKRCNEHWEVAPKSEIGLYLGDIQDHILTMTSSLTYYET

SEQ ID NO: 42666 - protein, 103 aa, A.fumigatus
RVPYIRERGPANQGHRLLSRAHSNYLAQINILMNERQEQTADVLGRLTVLGTIVLPMNIICGMWGMNVKVPGQDIDNLWWFWSSKDSLHYALFFRGFYYEMVI

SEQ ID NO: 42667 - protein, 426 aa, A.fumigatus
KCKTWLLNYVVSSSNRVGVWAKYLVALSSSFTSGENGHTSKPTEVRPGTSSKRKRLHILYLINDLFHHTKYHTDTPATFSTLSGSLQPHIVELLGYAASYDRFKNPKHHRRLDDLLNIWEKNGYYGADYVNKLREVVKNSAESGPVKSFIDVEQNNMDTVNRSVEKNVPFVMPSTHGDSSTPYYDLPAGNLIPHIIPDSTVPLRPDTIKPLQFLAGSADEKLVTALKAFLKDVDRMYNSGQTEQKENEVVDIDEMGQTIIRDSSTGEIVGGDTYYGWSRAFCQQMKKRRAKGSSRNRTRSGSRSRSASRRRRYSGSSESGDSRWRSSSSRSRSAPRRHEANDRRYDSRSRSPRRSRSRERSYSPRAPSPPRYPPPEHQTSQYSNTGPHGFHSSHPPPPPPMHFAPGGNVPPVPPVPPAFPPRIAPG

SEQ ID NO: 42668 - protein, 98 aa, A.fumigatus
KKFLKRHASQTQGYRQYGLSDENMSGWKADHRLGGRSSRASKRATPVPGIEDVGSSDEYSDYVDEKDDNLKGKRSHICNRRCHTPDRLLYRCCGKILP

SEQ ID NO: 42669 - protein, 194 aa, A.fumigatus
ASQPSGAHTGYYDGLPDRWLLTIHEAYFTGAAQRPPKQVKLDFFLMHCVTSSIFLSKIVTLPYLDTRTKLRLLEWKGRADLVFYVSRGVPDLLLEEVTTYEAPNDWKTIFYESSVHPRDDGHLSKLVRALANGEKVCRPFEARAEELGLLITGDMWLKIANMGKPDARIRLTLRTMFQGFADDRLRTSYQFNQR

SEQ ID NO: 42670 - protein, 124 aa, A.fumigatus
KASAPISVTGDVILLTVFYTDVVEKFSLESFSNKKNPSVSKHDPNFGYKDFSSLALKPDHANRPLWIDPLKGTITLGEFLPTGASGPRLSDHDRRAPFTPDTLARIPLDWEQFVCGRVRRPAAH

SEQ ID NO: 42671 - protein, 509 aa, A.fumigatus
TTYAEFPIFNTMAGEEEDINRTNNPPPFTERVHDHNPFVAFRRYADEQISSMLQAVMGLPSSISAPHSNHWAIFAEEHNCREPNYRQRQTGEGKEGEYPASSGTGASGNTDNIGQDDKPPASSRWPRSDDPWHSLHHGRFDRPSDFFSLDSFFDSFFDRFWFDDHFSSRFFHPFHQPFFFNMLNDDSATWPLAYLMFSPYSPLHLERQASYRAHRERGVFSSLISSLKPSSERDPAEPQWREAFEDLLRLENGKPMLDREPRTTLAKKESGTEWLKGLVQRGSLGDRWKYVSGPDGQGWSGITLESIEPADKDPPRTNESPTQQTQAVADWKDTKSAPETELDMYDRFLADIETREREFFKGAYESPLLRSLLEGRRRLKEEIELFEKEGPSKDTDSWIDLVSDGDKNTVPETAPQSTSGSSTTGETRPTASATEQQPYVVSTRTSTERIRLPDGSIQTKTVKTKRFADGREETNESVEVMNPPPTSQDSVAGQEALENQKKRGWFWRD

SEQ ID NO: 42672 - protein, 726 aa, A.fumigatus
KAQSRWESFSPLAPQAQDFLTTIAEPLSRPTHLHEYRLTGNSLYAAVSVGLQPTDIINFLDRLSKTPLPDTVKSFIIDFTKSFGKIKVVLKHNRFFVESTDPAMLQMLLQDEVIGQQRVNGSEGIIQQAAPKMGGLVIPGTKDAAGVQQTSEEKPANGVPGQERKEDDILLAIRDDDDDDEQAQVHSFEIPNEAVESVKARCQAMGCPALEEYDFRNDEINPTLDIDLKPNARIRSYQEKSLSKMFGNGRAKSGIIVLPCGAGKTLVGITAACTIKKGTIVLCTSSMSVVQWRNEFLRWSNIDPGDIAIFTSDNKERFRRSTGIIVSTYSMVSQTRARSHDAQKMMDWMQSREWGLMILDEVHVVPASMFRKVTSAIATQSKLGLTATLLREDDKIKDLNFLIGPKLYEANWMELAEQGHIAKVQCAEVWCPMTTEFYTEYMREKSRKAALLYIMNPRKFQACQFLIDYHEKRGDKVIVFSDNVYALERYALKLNKAYIYGGTPQNERMRILENFQHNEQVNTIFLSKIGDTSLDLPEATCLIQISSHYGSRRQEAQRLGRILRAKRRNDEGFNAFFYSLVSKDTDEMFYSSKRQAFLVDQGYAFKVITHLQGIENLEGLAYATPAERRELLQEVMLQNETSAEVENVTDDLFSERSGGPKGRAKGGVKRSAATLSGLAGGEDMAYIEYNKSRNKQLKDKAGHHPLFRKLERERLKRKKELQDIMR

SEQ ID NO: 42673 - protein, 110 aa, A.fumigatus
LCLVIRLSAETIPIPTTSFTSTQENCRYVRAQACYKLSSKLTHLFPFEVNGTHLSADSNSFLEKRRRGLVRFTNALVRHPVLSQEQLVVMFLTVPTVCISACINGNEKLT

SEQ ID NO: 42674 - protein, 199 aa, A.fumigatus
ELSVWRKQATISVQDEFTGRVLPPDLEDSLPANLTDIFETVRSGVKRSAEIYINLCTLLERLAKRNEGLAADHLRFSLALQSLTEVTKDTYAVDTNDVPILNEGIMATARHLSNSQSLLEDEARAWENGILEDLKFQRDCLVSVREMFDRRDRYARNNIPQLERRIESNERKLEELRTRPQGAVKPGEIEKVEESIFKV

SEQ ID NO: 42675 - protein, 382 aa, A.fumigatus
  UNSURE (342): Identity of amino acid sequences at the above locations are unknown.
RGSFQPPGLNTGCGKTASVYAVAKELDFEVFEINPGNRRSAKDILERVGDMTQNHLVHKVAASEDISNDHSLGVRLEAPAPDESKQNKFMGFFTPAAGKKPKKDKKAGQKDSQQESDSKRARSQKQSLILLEEADILFEEDKQFWSGVMALVSQSKRPIIITCNDENLVPLEEIPFHAILRYKPPPQRPTVDYLLLLAANEGHMLKREAVDDLYLATGRDLRRTIMNLNFWCQMAIGSEKSGLDWIIDRWGKGAEIGHDSDPLRVVSLNTYEPSMGWFSRDMLLDNTLDSRIESTRELLHWWQISLQETDEMADSSFENVSSAGTTNFDHTNLEHLQRLNVXSDYADLRSVLDVLCARCSLDQKQVRCVGLEDNSKTNYQFP

SEQ ID NO: 42676 - protein, 232 aa, A.fumigatus
DSINNTIPAMSEKQRTNYVEGYPLLQADTVPDYSSFLASIGSTFEVFMGQTFREEQQKDIEASQARNVLETVVAPRRVNTSKATFLTAFEPLRRADHLFPPPPGRLAPSFENRLGPLSEDLAPYIRAIVAFDLRLEHYRLQLSGLLSENDGGSKRMRKTRASRAALEGGSKAETRKERWFPPGTNPALVLATGNKEWQDLLVRTGHFTVTSIRESTKECSDLASESSGDGGI

SEQ ID NO: 42677 - protein, 116 aa, A.fumigatus
RIAHSRLSIMSLFGTSPDDPSMGDSVHQRSRSSLFADEPLPGGAGAGNSANLGSSSLFADDDGFQSSSPWNSNANKRAARHELVKTLLPDADVPESYIDAYDLVLNEGIVSGASWA

SEQ ID NO: 42678 - protein, 309 aa, A.fumigatus
TFANALVELPLPKSSYLDRLRDRQQPSAPSHPEERPTTPPPPPAAINDPPSARSRQSRETLGGLDADPWGSPQLHRGHNHVQTEPEPPVLNGFGSVRSATNAWSSGAGEDETQHEVPSGLRANGRTDGAPSTSSGSGWGGSYRNTTAGDGFGGPIRAGLGNLGAPSSGQEEPNARRRLGIGISTSSQVEETVTVNLLPEKEGMFMFQHRNYEVKSSRRGSTVIRRYSDFVWLLDCLQKRYPFRQLPLLPPKRIAGTSEHRLATSSPQSLLTYFHLKSMALTFQRIQTRSLKSGAEASCGSPTRSFVILF

SEQ ID NO: 42679 - protein, 77 aa, A.fumigatus
HNALLALQDKESIVQQHARGVFIKECIRDELVHFQRSQYHISRLHQDWSQERVKYSELQADNWRSLSDQVEGMPLGE

SEQ ID NO: 42680 - protein, 1087 aa, A.fumigatus
  UNSURE (511): Identity of amino acid sequences at the above locations are unknown.
VNMAWHHLDIDKPHLAYMILGGFTGLFMLCSLFVKEKLYIGEATVATLCGIIFGPHAANLFNPAEWGNVDKITLECSRIVLVVQCFAVGVELPKAYMERHWKSVSLLLVPVMTWGWLVTSLFIWWMVPPFNWLESLVCAACVTATDPVLASSVVGKGKFAKRVPKHLRDLLSAESGCNDGMAFPFIYLGFYILRYRPDAGKVSLNWFCVTILYECIFGAIYGFLIGYIARHAIKFAERKQLIDRESFLVFYFVLAVFCAGSGSLLGMDDLLIGFACGVGFSNDGWFTEKTEESHVSNVIDLLLNLAYFVYFGSIIPWEDYNNPEIGLVPWRLVVIAILVIFFRRIPIMMLLKPVIPDVKTWREALFAGHFGPIGVGAIFAAILTRAELETDSTQPLSEKELPQPGSPDYYIVQLIWPITTFMVISSILVHGSSIAVFTLGKRINTLTVTLSYTTANEEGPSWMNRLPRVQSLAKGSMSFRKTDGDDLGDSSTEPEFPPGTLPPIGVPGNFXRRVREEESETPTGRPSSRKTRRRRRRDDGAGGPISQSAIMPQRPAEAGEETEKAGGEAEKAGEEAEKSKEEAQEREKIERGGSPPTHERDRFGREPVVEVYLEGHTMIIEDEEGNVLKTEDISHKSPEERQQHVEEQKRQLQKDKSGELSKSRSQPHEKTEGEQIQHAVGDAAGPSLGKARKQFGKWVGWGKGRGEQAESKEAKKAAEKKSTESGKPAKPKARSAHAYQFGNTIIVEDEDGEVIKKYSIPAAGKVEGGAPGRRGLGRMGTWFGKDGEAETSQAAQNKKTSKDEWLADDGLRFTLANDDEVSKRGVGHKGRRMTKHEFAEQIKNLDPKARRQLVEETDVPERVKNVARDEAEQRESSRAQPVEMPVSPGTQVETRGIDQFDSDSETTGDESVQDIPGPDVAASVARVTRGSAAQERRNQLEPSDSPSRHRPRSRRDSEDDGTERIPPARLREAAGLAPRPQEADFDDTGETPAERRRRLAALGELHNDSDSDDPEAAVEDTDSDDNNEFRQVRGRVQFADGSRASPRRDDAGIVSGLPSASPDQSQSPGRRGHRTRISWGGEKGRES

SEQ ID NO: 42681 - protein, 279 aa, A.fumigatus
PQELQQGIYFVVPDEHIDKARDILVEAGFPPCQLGKFCGFDWPKSFHGIPSARFNIVDQGPLNYSRPELYGPDPREWYSLELYKKSELMWGAPEIPLGPPAPNNPDYWTINDERLPEVARGLHQVRVVEADYPVKIPSPARYAEMLTLLYFRDNHPEETFRGSFWEVLMIDMQTVLKKHRLFTLSDLPPRTRSWWKILTKNIRERTHGDAEERFGDEMKKAGEVPEKSPWPSQRTMPDGWREELKRLEEEEERRKKRKEEQEEEQLRKNKEKVKEEQNA

SEQ ID NO: 42682 - protein, 134 aa, A.fumigatus
SSVLTLRIETKQQVKKEANDRSKKQTRASTSGDKKGQERTREDKRGQERTREDKRGQERTREDKRGQERTREDKRGQERTREDKRGQERTRDREWRRGKTKTLGADATHHEAGQFKDLEPRRQRRNPRPQPGNS

SEQ ID NO: 42683 - protein, 86 aa, A.fumigatus
INGKAMPSLQPDSADRRSRRCLGTRLANLPLPTTEEAKTGSVAVTQAAHTRLSSQLKGGTIHQMNKLVTNQPQVITGTSKRLTDFQ

SEQ ID NO: 42684 - protein, 1138 aa, A.fumigatus
HYSSDEPDWSSVKPVSETFKPILCATNSSKTIKQEKKLWNTAELLPEFLDIAARSVPRDTFRRQTHEAPWLETLFVAVAELAFSIVKQESSGSSAAYVSEFVVVLEQLFRIVLNRNVQLSLHTLLTHAAYTGLLKEGLSPVEWGLTALLIELGADIFLPNSGLKDSTKLLRALLEKILLHWRSGVHPTDSNYDTIKNGIVIPLLRAFLAARDLPTFMQLWYEQLIDVEEARLVDSSLSLFSIWEDDDLCNVYSDILRSPLTHATADAQMRAAAVEIRGEDGKISSAPGAFAQFVLLEAGLRNRALGAAGAREELNSILGTVTATLSSKQSFHWRWRLWRLARNILANNVQSAEDPLMVATWNLTDAAVNSIQRNHKNRMKHTCSALESFEAYQFALAAVKETTDTGRLESFHVLTSEVKDYIGTITKQDTLGSLASPWNGRVETLDSSVSLALGYFLTLVRNPDIWPQLKTDDRRALFENILGLAASQSRLPSASLETYPLNARFVQAWTSVVCHEYLLNSPAIAVDLVHVLSKQLKEDKEYRKLYIESLQRVPGPLIMRHQRGVLLDLLQGILVQEDDMAEIKLGLLSLMAKLADMPKTAATCTSDWEPMFTAAKAVTLQGTENDLHVMKAFRNLHRAVLSKLLVLSEEDRNKLFKKMYRKVSAKVLKLKFLDHDSMECFFFRISLSQFWLHREQLSGAFVEQELDSCRRYMFHLIVAEVRSVKDQLKKKKIEETVTLIKILDALEDFEDLVVDSIEVEKFLTKIESYVERSMDSRSSLRRLIRRRVFTGRRSDRSITGSVVQCAETLSLKHMFGEEQQLFIRATTEKFKSMSVDEVTAVIRELRELGFDGDRAPYHLLAAGVAVASLPSTEDKETSAAKELSLLCTAVTGSLSQSTSIEHFTFATECLDILLRNHTRCISQWNIDSLLAAIAVCASKAGPRINPEYAATIYVRLCKLMGVLLGLHRQKLGGRFHLILPAMQRLLNCLFARSRKRSRSMLSAKGHTQQPYWLAPLQASHAVHFTRLLTSLCDPTVSAVSRPTQSGGNRDALTDQTKKAKRIAGQYLQYLIMEYAQSSLRGSLVPEVKAAILPGLYAVLDVMSRETMRAMNAGLDVSGRAIFKGLYDDYVKFGKWNKG

SEQ ID NO: 42685 - protein, 94 aa, A.fumigatus
NTWMISSSMIVDGLSWWQSWICVWVGYFIAAIFICLTGRIGAKYHVPFPVAVRSSFGIWGSFWPVLNRAVMAVIWYGVQSYIGGECVLVSTSKR

SEQ ID NO: 42686 - protein, 264 aa, A.fumigatus
LLTRQCVTVMIEAIWPSYAHLHNSLPASAGVETKDFVSFFLFWLLSLPALWFPIHKIRHLFTAKAIYSPIAAIAFFAWSIARANGIGPVVHQPATVHGSTLAWAIVKAIMSCLGNFAALIMNDPDFSRFARKPKDALWSQLLTIPIGFGITSFIGIIASSASAVIYNTDPVWNPLDLLRMFLDGASSGERFGIFVIATGFALAQLGTNISANSVSAGTDLTALLPRYLNIRRGSYICAAVGLAMCPVCRSCSSVLGCVRTRTDI

SEQ ID NO: 42687 - protein, 174 aa, A.fumigatus
WNLVSSSNQFTTYLSAYSIFLSAIAGPMICDYYLNRKGYLQVKDLYSASKGGPYYFVFGFSWHAYASYLSGILVNIVGFAGAVGRTVPLGAQYIYNINYFSGFFVSAVMYYILTRIFPLPASSDRWNEVDSDDEVSYGQEVDADDVHTPGKVRSLDKDSDWDRKGAKIASGAMV

SEQ ID NO: 42688 - protein, 162 aa, A.fumigatus
VTLDGEESSFEHLNGYRNLQSNDNPDATPFNYNLTNFSHFGHENHSEAIHNTDNTSPNGSSPSTEYPSEQHLMVPSEYYTIEYPVQLPNACSDVTGSCLCGNDCACVGCLTHSGHNGFAVESSAIENNNLSPSSPSAKHESVGSPLVPGHTHATVQSPNPML

SEQ ID NO: 42689 - protein, 682 aa, A.fumigatus
TAHIATMVLAKSKNSVGLGNTLMKDRFGKGKASNQKKVSHNAAITRTAQDGSTYITNAAKEASWVKMRSITEQAALDEFLSTAELAGTDFTAEKMSNIKIIHSDQKNPYLLSASEEKSARKKHQQNKGKLTVPRRPKWDATTTRDQLEAMEKESFLEWRRGLAELQENNDLLMTPFERNLEVWRQLWRVIERSDVVVQIVDARNPLMFRSEDLENYVKEIDPKKQNLLLVNKADMLTEKQREMWADYFERNNINFRFFSAHLAKERNEARLLEEESDSESEEKEAEDLANATSSMNINDPQDAKNASIEDGQPEHDGGLKLPEYRKSRRTDILDVEELEELFLSSTPDTLPDSGNGAGQRKQKTTIGLVGYPNVGKSSTINALLGAKKVSVSATPGKTKHFQTLYLSPEIMLCDCPGLVFPNFATTKAELVVNGVLPIDQQREFTGPAGLVAQRIPKHFLEDVYGVKIHTRPLEESGTGIPSAHDLLRAYARARGFATTGQGQPDESRAARYVLKDYVNGKLLFCHPPPVPDGEEPIDPLEYNRELYDTAHLPARRQAMLARTAQANAGGEEFDDEAELLSVGSSSKQGRAVEGSRSRNLDSGFFGPGAKGSAGRLTLPFNAQYTEQGQQIRKQLTGRKERLMIALERGVNVSEVRGNSKKHFKGNKKRAKAKRTKAEDDDY

SEQ ID NO: 42690 - protein, 189 aa, A.fumigatus
MTLGLLESISQQQPLRLLLLILELSDNGVLARLVLASTKLLQVDLIGSVGDAQRPDHGPQIGQGRILADTGGAVGLDSAVDDGQGGLGDEDLGLGDLLESGLGVALVDLDGGVKDDEAGGVDLDAGLGDPLEDDAVGGQRLAEGLLAVVVDTGDEPLEGLFGGADGAHRVVDASGPQPALDNLEAAALS

SEQ ID NO: 42691 - protein, 287 aa, A.fumigatus
LPPPLQQHLSLSLQPPIGENGGQPRFKRSARLLLRKLRVLRKSPPSRPSYDPVSLTLLLNFIIVHFPCLLRLDLYSLAHSRLLDSLRFSSIHYIHDMSASTRIPPIAQPFVSDRAKRVLDLVRCLFTISPGYKFSNTCRGVQVEEFVEKDCIPAEAVFQAQLGEGEKRWQTNPAVLEELKAKARKLGLWNMFLPKNHFSQGAGFSNLEYGLMAEYLGKSKLASEVGDLSRVLAKSDDGGADWWIFRRRITLPLIPVTWRCWPSMAMRRRRSSGLLLCSTARSARLSS

SEQ ID NO: 42692 - protein, 111 aa, A.fumigatus
  UNSURE (19),(55),(93): Identity of amino acid sequences at the above locations are unknown.
LADFATDDPRGVSCKRQPXAIRTPFSSNRHLHTQGDSFPWAKVWQTSPPQAIRQXFVIPDNERYSEDFFLASETAGTSWFSVHQGTPSMASVXDSALGESFKFYCIPSGCP

SEQ ID NO: 42693 - protein, 794 aa, A.fumigatus
FGGRFCIETRWSRSGITVAGGPSVTMSSISSNSPPTSKASHTAVQQHSGKEQEQDTDSPLDNAKFLSFEDWKKQNLAKVGQSAENVGGNRRSGVTGNESRRRPTGISNALDSLGEDAEIELDFGGFGADAPEAARPPSFGSGVQVGKSAGSVDSKTGGDANGPSPGMIRSGSSRRKDAGTTCKERFNYASFDCAATVLKTNPECQGSSSVLIENKDSYMLNECRAKNKFLILELCDDILVDTVVLANYEFFSSIFHTFRVSVSDRYPAKPDQWRELGVFEARNTREVQAFAVENPLIWARYLKIEFLTHYGNEFYCPLSLIRVHGTTMLEEYKHDGEASRVDDEIVDETLEPDHAVTAAIAEPSENSSDLGAENRESMRRKLQDGLQDACPNPAQGLERLLANYLDSEICSVQARPTRTAGQERADAAVQHDSPSTDTTPPGPEASGPIVPGAGNGTKFAPDARRAAGQSGADGNPLPASMATMSEPVQHDTTSEADQKSTASSQEEQVPSVDSAKFSATQPPSPNPTTQESFFKSVNKRLQMLESNSTLSLLYIEEQSRILRDAFSKVEKRQLSKTSTFLENLNVTVMNELRQFREQYDQVWKTVALEFETQRIQYHQEIFSLSAQLGVLADELVFQKRVAVIQSIMVFFCFGLVLFSRGAMSSYMEFPSVQNMVSRSYSLRSSSPPFSSPSMSPSSTRPSFTYRSRHRRNGTDDTQDSAPSPTISYSPPTPNSETSVPLESIEKQESPPSPGDLELPDIELPQFRSQSSPPVLKSGEDSDGEISETSGSMEV

SEQ ID NO: 42694 - protein, 65 aa, A.fumigatus
SASEKSAPLYTMDSTPTAPLTDRSTNTHLAANQDKVNDLKTAAANLNSMEYHRSVLQGKLQNEDK

SEQ ID NO: 42695 - protein, 269 aa, A.fumigatus
KWWSSGAGDPRCAIYLVMGKSDPTNPDPYRQQSVILVPAGLPGITVHRMLTVYGYDDAPHGHGHISFNNVRVPVSNIVLGEGRGFEIIQGRLGPGRIHHAMRTIGAAEKALEWLIARVNDDRKKTFGKPLSAHGVILEWIAKSRIEIDAARLIVLNAAIKIDQGDAKSALKEIAQAKVLVPQTALTVIDRAVQAYGAAGVCQDTPLANLWAMIRTLRIADGPDEVHLQQLGRRENKSRQDAIVAKLKYQKEEAERLLLANGFQKPKSHL

SEQ ID NO: 42696 - protein, 416 aa, A.fumigatus
  UNSURE (75),(111),(149): Identity of amino acid sequences at the above locations are unknown.
GIPSFFLRNFSPNSSQGNFGKSGGIPLANKSRRKRFAWGVPKSPWGGCFPSPQRRGNWRILQPTTREVFPASANXELFGPPSVQTGICTPKGILSRGPKFGKPAPHKPSAXCLLFPTTRDTPRTFSLPRKLLVLPGSPFIRALHLWHPXWTPHWVSLSSFIAFRPVAPRYPPPSDPVPITGSLPNHAAKPIPSLSMVFGRNKNDQISKSWSDLWDEDEEFEHEDVVFQERHEANSRSWSHESSSMDVPTPSAGLRESKSSSLLNARSSAQQTPSTKPVNIATKSTLDDVGTPAVISAPRFSQSSPKKSNLDKWAALGDRRRNYKPAEKSFGQPKSSINMSWRKDWGLGSSGFDYGSWAKKDNLAHQDRRRRPFLEKGRRRDGVESPKAVKPVTPSSYDGSIDEDLDLVGGWHDLHL

SEQ ID NO: 42697 - protein, 145 aa, A.fumigatus
LVDFQATNNSAPDTGNMEVLAKYGNEAQKKQWLAPLLDGKIRSAFLMTEPDVASSDATNIELNIRREGNEYVLNGSVCRRFSPFSLEHPYSPIADRNGGPPALVTPVAQSTWSWASPTRPTQTPTANSLSSSCPPVFPASPCTGC

SEQ ID NO: 42698 - protein, 212 aa, A.fumigatus
CSPVTRLTLEHSDKKNATTYQLFHRSQNDPLIHDPEADDRVLHPVSGPSLPISEGKKRSKNLSDLSSEFGSDSIRHNEGEAANYGIYFDDTKYDYMQHLRELGAGGGESYFVEATSKGKSKAKGMKLEDALKQQMTLDDTRSEFGAGSVYGSEYTSDLRSTTSSYSRKPTYQDQQDVPDAIAGFKPDMDPRLREVLEALEDEEYVDPDDEED

SEQ ID NO: 42699 - protein, 118 aa, A.fumigatus
CTPKTCPNHNDIVANCALQSFTVSVDPYHHVKRLDLKAFDETPMPPMYLIFRPPQMLPTTTLNPVSSETGKSKRHIARDIGSPVGIDTLRSDHIGDPDRWLWFGILMTAMGGIALIYS

SEQ ID NO: 42700 - protein, 228 aa, A.fumigatus
SPWFFFRLADSPFAEGFSSDYDIPTSPSWAPFQKVKMYNIPDQIFDQYNRAQVSTSMGLFAELNHAWVAIDNALYIWDYTHPNPQLVGFEDQPNSINAVKLAKPRAGVFLPSITHLLVISTTAEVILLGMGCETTPGGARQVSLYQTGMSVSIRGLDIHVIASSDATGRIFFGGSTDNDVYELTYQQEERWFQGQMLQSQPYQFAHRGFHAQSEFHSEDYGDGGADGD

SEQ ID NO: 42701 - protein, 87 aa, A.fumigatus
VSQCRDRPGRLSAGAQPLIFPSGLHQSLTSCFILQDFYDPINDRLLEPRLTGISYSLPADGYYEQAYYRGRFQPSVAPHAFPSEAAF

SEQ ID NO: 42702 - protein, 90 aa, A.fumigatus
PDLYSPATTPSCPKGIMLWQHGKYDVMPDGSIQLTPIGLDVRQLVSDPCSKEVAVYARYNQTEAFSVRRRPVPTIMISLLTVRCSHLRSP

SEQ ID NO: 42703 - protein, 685 aa, A.fumigatus
SLRRTRPAVSSSAALLTTMSMSSHINRRNGGSRGRCSKVNHTSSRIAAFTPSLSFTQKTTETVEQMEIDDTRRLLYTLSSSSTIRVFHMKPDGTLALAITKPAMDIYANIGHIIASNETLNPKVPIVSISPIPAAEASRYHLMATTATGYRIYLSATASYSWSPAPNGTNAPTSMQAHHVKTPPFDNPPSTPVELGQPRFQTSGASRVPIHSLNPTRFTVRYPPGYFFCFTCKDPTQKTDTLFISSPDSGRVARSQENVIPGKAGETGIWLSLGSRAEDVGLCSAPSAAASTPGGFGNELAVQFDSAAAEIAILTNTGIHVIRRRRLVDMFAALVRGGGTGGDEGLEGEVKNFIRTYGRSETLATALAVACGQRVEVSTDSRLTQINDPDVLEFARKVFIEYGGRPTVNENAVADSSTPAIDTVILSPRHAGIALYMSRLLRSIWKKEIVTVGSGPNGAQTISASVPTTKLQSVQRDLSALQDFFKANKSFIEGLSGPEALARVSTKQEETALQAEHRALHSLVQLVSHTIEGISFVLVLFDERVDEIVATLPDESKQRFLKLTFEELFSTSKGHDIAKELVKGIVNRNIAKGSNVETVADALRRRCGSFCSAEDVVIFKAQELLKRATEAGANSEIGRNLLNESLHLFQQVSDSLPMDYLVSAVESYISNQFFAGKSSYLSHGC

SEQ ID NO: 42704 - protein, 243 aa, A.fumigatus
RCRSPLVTLSGRQQANPPPQDSRRDYFYFRKQCYDLIFKVIIAVDNLAAHDPGVVDGQLTIIAKRKNEAYGVISDSTDEVFLTSLYDWYLEQGWSDRLLQNNSPFVVTYLERKSADDIAHADLLWRYFAQSQRFYEAANVQYHLAQSAFALPLARRIEYLGRARANASIFTPDVGRQSRQRLVQDISNLIDIANIQDDLLQRLKDDTRIAPERRTEVLKEVDGPIMDISTVRFSSNHAFVRAY

SEQ ID NO: 42705 - protein, 206 aa, A.fumigatus
SVLQLFNQYADPASYYDICLQIFYLADYRNSADIRSTWQHLFQDLHDETLAKGEPQPYEAVIEKVRSLGSRLRMSETVFPIKDLLPMLERYALEHQRDVGPPTWIVDLFLDLGVAHETIYAVLEAMYYTDEAPFHGSNRKYIARDLLYLIEVWYHETVRLGGIVFGSDAVAERVSETLLLLQQGGIAPEQMQAAHELRTRIVEILR

SEQ ID NO: 42706 - protein, 138 aa, A.fumigatus
NTSRLNVLRALISETNNSTKTSSPIQTDLQLLSLIRKRVAAAKEAANQFAEADRPDLKEKEDAQVAILEEYAGKVETMSLEDIKAVVSQEVSKLKEAGKKVEVGGLLKSLFAPGGALDGKPAERAEVAKIAKEAVASV

SEQ ID NO: 42707 - protein, 395 aa, A.fumigatus
LALFFPAVSLSKLFSPVISPLSGIPFIMPASAPVTPPSKPQAVNPHEDEIPISYDINIPYVDVAKESTSHTRYPEYLPTWDKVWFDPLPPFKYEDPALRVKDKSKRNLLTPGVKVSHIQPQIGSIVEGVQLSQLSDAAKDELALLVAERKVVVFPAQDLIDAGPEKLEQFMRHFGKPNYQPVSGTVRDHPGFHIIHRDGNREEIARFLEQRTTTTLWHQDVSYEIQPPGYVMLGLLEGPEVGGDTVFAATDMAYKYGFPPSSSYAEKQKTDRSRRLSPTFTSFLDGLRAVHSSAKMINHTRLLGGLVRKDPVDTVHPLVRIHPVTGEKCLFINGEFITRIQGLKEPEQRYLLDFLMQHIMTGHDFQARVRWQPKTIVIFDNRCTIRKLFLPSHAF

SEQ ID NO: 42708 - protein, 208 aa, A.fumigatus
LSIARVATDKLFSLSEYQNAKRIGVYLSMPSGELSTTAIVQDALTHGKEVFVPYIHSIDSPSSTQKKTSVMDMLLLKSMEEFNSLEPDKWGIPSLTKAQAENKRNCFGTIGVSTNMGEDSTQRFEGLDLIVMPGMAFDQGFRRLGHGKGYYDQFLTRYSIKVAEKKTTTSKMPLLGEEQPHPKPKLPLNDLTDSISCPFPQRANASLE

SEQ ID NO: 42709 - protein, 85 aa, A.fumigatus
RLHPCFLHIHLGEFALQLLERPPSGIGSRGRKIIQAVTDGLDRWRLVPMRPRSWAARTTGIVGIMQQSLSFRIVAGFIGAKMRSR

SEQ ID NO: 42710 - protein, 395 aa, A.fumigatus
LFASPDIYSIALTTCSSLLRKYNIDPKSIGRLEVGTETLLDKSKSVKSVLMQLFAPHGNTNIEGVDTVNACYGGTNAVFNSINWVESSAWDGRDAIVVCGDIALYAKGAARPTGGAGAVAMLIGPDAPIVFEPGLRGSYVTHAYDFFKPDLTSEYPVVDGHFSLKCYTEAVDACYKAYAAREKVLKAKIQNGTNGVENDETKTPLDRFDYVLFHAPTCKLVQKSYGRMLYNDYLANPSHPAFAEVPSELRDLDYEKSFTDKTVEKTFMGLTKKTFAERVRPGLDVATLCGNMYTATVYAGLASLLSNVTFDPSQPKRVALFSYGSGLASSMFSVKIVGDVSGMVEKLDLHKRLNARTVLPPQTYDEVRNQCFPPPVIIWTDIVSSRCASCVSTPT

SEQ ID NO: 42711 - protein, 113 aa, A.fumigatus
FTGVKLEPPPCFRLFYSGSVYRMLFLALGRMASLRRAFNIQTFSILMPPQLIIFALIEHDSAVLAFQLEHLNTLASVLLYHFVGGHYSLTARRKLALPDSYSLIIRCERKNCD

SEQ ID NO: 42712 - protein, 63 aa, A.fumigatus
IFSFIGSFFVFKIFTFISHKHREYVAHCRSFLIQIMIPLTPASVTLSNFYGSPEPHPFRHGQR

SEQ ID NO: 42713 - protein, 486 aa, A.fumigatus
RNDVSPYDYRRGKTLVSYLIISLRWQDGSGVEALVQVKLLNHTRDIANNFDTEHGAGETTAVREEGDALGLAGIEGDVAEQAGKTSIHGGRVHVTTEGGNIKTGTHPLSESFLGQTHEGLLHSLVGERFLVIQVTQFRGYFGKGRVAGVGEVVIVEHAAIGLLHQFAGRRVEQDIVKAIKGSLGLIILNSVGAILNLGLKHLFTSGIGLVASINSLGIALEREMAINDGVFASKVGLEEIISVGDVTATETRLEHNRGIRSDQHGNGTSTTSGAGSPLGIEGNVSADNNGISAIPGRRLDPVDAVEHSVGTTIASIDGVNTLNVGVSMRGKQLHQHRLDRLGLVKKGLCADLKTADRLGVDVVFAKEGGAGGQSNGVDVWGGEKLTFRAYEDQGSGTIIPSRSSQKLILVWPRPIVYFPSLTPSNFSNSAWSTHWTCHQPCCELEMLDRTRFKGSRPTYLTGEVDLNGLDTNVLGTSRHGGGGSAN

SEQ ID NO: 42714 - protein, 922 aa, A.fumigatus
RCLTSTAPPSHIHSAMGNDKKFEYESLPIPSYEEAISSRPSSSRSHLGPDEASDDAERQGLLHNADNTSGPGGPRSRPHGYQPPTVESVRNSLDDLASSGTDSARGSLEELQRELAQMDVEEAGVQSSSRRSRLGQHFSKRFNSLSRTLSAIQFPFRRFLPNFRFTINLDGARPRFQDHSCIIMLRVFGLLLVVALVYVFFFSNLFNLNSRFMMGQSYSAASVQNFLQGHINETNIADNLRKVTKFPHMAGTEGSFALAEWIEQEFKNAGLDEIEMEEFQVYLNYPNEGGRRVAIVDPPGMAWEAALEEKNEQTMVFHGHSKSGNVTGHLVYANYGSREDFQLLADQGIDMKGAIALVRYYGSETDRALKVKLAEMAGAAGCIIYSDPHEDGFRRGPAFPDGRFMPDDGVQRGAVSLMSWVVGDVLSPGFASTPQEKKRLSIEESPGLPGIPSIPIAWRDAQRLLQVLKGHGTKVPKEWVGGVPEVQEWWTGDGGSPKVNLMNILDEVERQPIYNVIGRIIGLEQPEKKVIVGNHRDSWCLGSADPGSGTAVFLELVRVFGELRTFGWRPLRTIEFVSWDAEEYNMIGSTEHVEKAIEALRENAFAYLNVDVGVTGNNFDASGSPLFQRIVMQILGRIADPITNETLKDIWERAQKKFSPLGSGSDYVAFQDIAGTSSVDFGFTGERFPYHSCYENYDWMTKFGDPGFQYHKALGQFWALLLIDLADNPILQFDLQVYADHVHTYVTDLVAYAKSKNVPVAPQLLEDRAVGEASVSFQPLFDAASKFKSDAEEFDQWAQLWHDTVWGAGGFENNVMAIQRLSHNSRLASFDTQLLDLDHDGGVSTLPSHITSVPDTDSFRQIPNRTQFKHVIFGPQLWSGYDAAVFPAIRDSIDSGNWTLTQEWIDRVAKIIHRASNSLVHN

SEQ ID NO: 42715 - protein, 116 aa, A.fumigatus
HSLSGGLGLTGGIADVGGLYDCLYGLYTGRATPDILDMYDRVRRKKYLEVIDKLSSDNLRRMFETDPDTVIESGSDELFNLCLKAEKDVELAKQLVTGINVIKYDFTQHYSEAGKI

SEQ ID NO: 42716 - protein, 291 aa, A.fumigatus
IIVVGAGPAGLLLALMLSRQAIPVTVLEAAEQLDTRPRATHYGSPAVYELRRAGVLPDVLAEGFTPGVICWRKLYGTYLAGIDNRIMANDPDQVACLPLGRLGQILLDHLARQPSAEIKWNHRVTGLGQDPDQAWVTVATPTGEVTMQATYIVGCDGANSQIRRSLFGDGVFPGKTWDEQIVATNVYYDFHQFGYEDANFIIHPEHWYMASRITKDGLWRVSYGEKGGLTHEQLAERQPKKFQAMLPGHPTPDQYRLVNFSPYRVHQRLAEKMRVGRFLLAADAAHLCNPL

SEQ ID NO: 42717 - protein, 82 aa, A.fumigatus
VSSPLSFLIKSPISRYAFLLVVTWVVFEMNLLLIFKRVLRLVSSHVLHCARTKLCVYLINIWQALNIPRAIEDNNVRFALCG

SEQ ID NO: 42718 - protein, 76 aa, A.fumigatus
WTADVRKVKSHGQLNLHSPEICSKLRFYSPRPSGLSQSPPILKEAYFAYLDLNKDYGYSITGVARSPSLCDTIRLL

SEQ ID NO: 42719 - protein, 100 aa, A.fumigatus
HLSSGSRYGFTLHSMASQTQTGQRPKVQPCRYKTGKTLGAGSYSVVKECVHIDTGRYYAAKVINKRLMAGREHMVILSETENPALKVNVDIKRGLMCGMV

SEQ ID NO: 42720 - protein, 65 aa, A.fumigatus
LDAKLIRPSANAGFDLFDDELINESRANSNMNASDYIIDIREYDVPYHVRVAIDKGGRLNPHICQ

SEQ ID NO: 42721 - protein, 1320 aa, A.fumigatus
TTTDRSKDIRIGKWYTVEAKHGVISLTCLEERLQRADPVILAFDIETTKLPLKFPDSVIDQIMMISYMIDGQGFLITNREIVSEDIRDFEYTPKPEYSGPFMIFNEPNERSVIERFFEHIKEAKPTVIATYNGDFFDWPFVEARASVLGIDMYKEIGFRKNSEDIYQSDHCVHMDCFAWVNRDSYLPQGSRGLKAVTVAKLGYDPDELDPELMTPYASERPQTLAEYSVSDAVATYYLYMKYVHPFIFSLCTIIPLNPDDTLRKGTGTLCEMLLMVQAYKGEIVLPNKHKDPPESFYEGHLLESETYVGGHVESIEAGVFRSDIPVTFNIDTTAIDELLRDLDAALKFSIEVEEKKSMDDVVNYEDVKAQIAERLVNLREKPHRDEVPSIYHLDVASMYPNIMITNRLQPDSMIQESDCAACDFNRPGKTCDRRLPWAWRGEFLPAKRDEYNMIRQAVANELFPGRTKNSPMRSFGEMSAEEQAAIIKKRLQDYSKKIYHKIHDSKTIVREAIICQRENPFYVDTVRSFRDRRYDFKGKQKVWKGKTEALKAAGASAAEIEEAKKMIVLFDSLQLAHKVILNSFYGYVMRKGSRWYSMEMAGVTCLTGAHIIQMARELVERIGRPLELDTDGIWCMLPGSFPEDFSFTLKNGKKLGISYPCVMLNHLVHGKYTNHQYQTLVDPKTFRYETHSDNSIFFEVDGPYKAMILPTSKEEDKNLKKRYAVFNHDGSLAELKGFEVKRRGELKLIKIFQTQIFRFFLEGSTLEETYAAVARVADRWLDVLYDHGATLADEELIELISENRSMTKTLEEYGNQKSTSITTARRLAEFLGEQMVKDKGLNCKYIISAKPKNTPVTERAIPVTIFSAEEPVPRFFLRKWLKDDPGDMDPRSVIDWDYYLERLGSVVQKLITIPAALQKVRNPVPRVAHPDWLQRRINMKEDKFKQTKMTDMFGKTEKNPLSNISTNILDHRVQHHGDIGEAVANSTQKLKSSPNGKISQKRKHPEGLTKTLLDPFASLPAIMPSLNDDYVGFLKYQKQKWKIQKQARARRRQLFGERVNVATDSLSNLFRNQAELLYINTWQILQLCETGRPGLVRAFVLIDRKIHALTIKVPRQIYVNLKRDSLPDVDVPDCEVEKVNHTLPNGHPSVHLFKLTLSEDTYLRETDKIDALLQHPSIEGVYEKNIPLSVRAVLKLGSVCTFDEEQRGVLGEGLDRGFNLSTLCHTTPDEPYLLNSPLVYHYLYHVLSGDRQIFALFSTTKSEAHIVILNRTRDVQGLPNVDKIYAELRARTMENMGGDQSQNAFEYQEKIHFKDHPSDD

SEQ ID NO: 42722 - protein, 332 aa, A.fumigatus
QCLCDVTVYLVTELALGGELFDRICRKGSYYESDAADLIRAVLSAVAYLHDHGIVHRDLKPENLLFRTPEDNADLLIADFGLSRIMDEEQFHVLTTTCGTPGYMAPEIFQMSGHGKPVYVFVRVLPLANLNSMADFPLRDIWAIGVITYFLLCGYTPFDRDSNLEEMQAILAADYSFTPLEYWRGVSQSARDFIKGCLTVDPKARMTAHEALQHPWINPPYDLNNDSGSGEDLLPTVKKNFNARRTLHKAIDTVRAINKLREGGGLMMDGVMSLDPKPEHVNGNEVTEEQHDGRMEIDSRGDARGQTEQQIREQERKVKETVAGLWSQSAKK

SEQ ID NO: 42723 - protein, 754 aa, A.fumigatus
THPWFTITSTMSSRVIGRYSLYFQPQRAKRTLLSSIARGMFKACQMLIRYTQSFVRAQWRTWEETSLRTRLNIRRRFISKTTQVTTRRKAYLEIGDLIKKLKGEETQPVIMVIQSHQRHRLCHDIPILKEYPVLPVKPEVSDMDLPPLGWQSFIAKRLVTHYLYLASWIHHLTMLARYGDVPLCNLENDDPRYLIDISYARRLQQNNVVLWWSNGPRPDHAGYEKDDVTGSLERVSMPSVNVPSAYNTVCIELEVRNLSINTILTSSIINELEGADTLLASSEPSADANGSGVLYSEKAFASAGAVVLREMVKHWWSEACEGNNMADIMVQHLIRWVESPVSCLYDRSLHDYVRMLSRKSFQRLMAEFRRVGSNVIFASPTRLLLQTTKTEVGNAYAYSQYVLKSIRANASFHFIDLEIKEYWDYLVWYDEYNYGGKGCRKVTGSEDQELETVMHWQLSRFLPAPMQTIFHDWVVEYIELMHGLKRTDSDDSSTPRLTQLPVGNHNEDNDEITSILAEKFSKPLKKQISGLIRRQRDELLHPELASDYVFPVLPGVLVDPNNDKRNPVLELVKLLMQVLSLSKTTTLETRLLRRELLAMFEVREFSKEGRFENPGASLKLPELSCNACCLIRDLDLCRDEDVLPEMGSDPNKAAPKPWRCPFCQTEYDRLAQEEALIGQVQGLIVGWQTQDLKCSKCGGLKISDFMEHCSCSGHWVETMDRNEVEKKLLLLSSVSKFHGLKLLESVVQGVLEQM

SEQ ID NO: 42724 - protein, 85 aa, A.fumigatus
RFTVNDAMIIVRDMAGDVSQQAADRLRPSQEQLSQVDQPAEENVWHEKPNIPKEQLKSRFQKSKVRSSPDSLYAHMLTSLIGRSW

SEQ ID NO: 42725 - protein, 346 aa, A.fumigatus
SRYPVFKPISEVGSISKHDDIVRLCFTNSSLDVSYYIKKKQGFPSITDKGVMDIFLGNEGFGFKIAASTAHKEDRQHFVKLDKVTVKIHDLDIKLRKSKHKILFAIFKPMLFNIVRPTLEKVLEKQIHDAFVKGDAFAFEVNQEVQRAKEATKQDPANAPNIYSRYVDAARAKLTEKKQKAQAVAQRDTKIQTVTTLHDSMFPNIKFPGAVSNKATEYTELARKGERWESPVFSIGSASESKDIPKLASIQRKPHRTAEGRLREKPDGRPMEGTDGRATQGGQVGADGYPKTGYPSRGFADEMDNAFTNGATNGHTNGHQNGAATKVTAEGLTVRGTPEAFNPQTA

SEQ ID NO: 42726 - protein, 169 aa, A.fumigatus
HSFFVGLVPGDSLSLATQTSQPEQVQQQAQDPIAQTQSSEMTAQNETMVGASPPPVDSSEEIPHARGPPIVGVEDMGLQDGKGVEMTLAQDANAPADQSSAPTDQPRSTADEQTENQKPASRANADSDGDIQLDDVKEAGESAPAATATGAAAEAEANETLQTTENKDF

SEQ ID NO: 42727 - protein, 203 aa, A.fumigatus
TGGDGQEIIRPHKHDVGGFHGDVRPRSQSNPDRCSCQSRRVVDSITHHGDTITGFLHRCDYGLFVGRGGRGVNEFRGYPNDRSDGQGSRPGISSDERSLESHAMQSSDRSHGSRFYSVAEEDSSGKLVINGHMNLRDASSRLRAAGELIFSFNRFRNRYTLRPQESGVADYSTIPCPLSIERGLNQCRYSLTNMGIEVTQAAW

SEQ ID NO: 42728 - protein, 99 aa, A.fumigatus
EEAGDVANTATQSATGGQDPATAKDVDVQAGVGSAAQKAKEKVPEDASQEAKSRAQELKERTRSYMEQKMPKERREQVIWRLKKMVIEIQGHPDCKFNL

SEQ ID NO: 42729 - protein, 174 aa, A.fumigatus
QNLPRCRQGPGTQRLVQEHGHLHQVSLTAKVDYTDHPDSSRKALQEQGYIMQEDCNREWDRLYDHGRYLFGAIAYKDHTDRILDEIRFIGDQFNQDPQNRAFRSALEKLFNDLGRDASGNVAFKKHLLKDIRDVILPSVFENVRYVPVPRIEVSDPMADVVSLLQDTVLRIFGN

SEQ ID NO: 42730 - protein, 157 aa, A.fumigatus
VLGHERWGAMGGGDVDGGLDAEVVTEEFQARDECLEVAIGAHHHSNGGGGLRRAGLDGLCLDVAALRADLVNNVDQGLDVFLGFVHRGRGNGDVAHLAAGLGGALAVEVNAGVGDGESGLGGFQVGVWGGAANDVEHDGRLADFEALRGNGEVENGT

SEQ ID NO: 42731 - protein, 230 aa, A.fumigatus
NVYNAFPMPKFHVETQSPAAQQQPSSFSQEPNSVPPSSNQENTPPTETENPSHSTIPASAATPSPSDERVPDSKPQSVVDSPADTLPPPLVLLLDSIKSTLKTFFASKPPHTIQRLAELVLRPNAHYRTLPAYLRAVDRVVSVTSTADIFPLQTEPSAGQVNGVLNGGGHGFMFPDHAPGSDESLGGALLTPIPWLTGASSPDNDGGATLSEGNAFSSLSPYIAVNTRSS

SEQ ID NO: 42732 - protein, 176 aa, A.fumigatus
DRKKAALPITARYLVRSPLNAGSINADIPLPTWALKSPKLPGSPSLSEWPDSALAAERMALPIGCSLFISARPTINHQSRRRPSSHWRSILASATVIFPVVRVPVLSKTTWLILVAPSSTAPPLTRIPCCAPTPVPTMTAVGVLRPNAHGQAKTMTEMQSFRQTMTFPPLPSATKI

SEQ ID NO: 42733 - protein, 138 aa, A.fumigatus
NKQCDVALNSAITSKALSSPLKELSSEGQALVKDLRVVIDEAKKLILSKNEGQLLQDFIWEAQKIGTGEAPVQPDVPVSKESAQQDADRAVEGLKTLGTLLITNGEFRKLCKCIPLELSAESSSVLTLHSERCYDHRS

SEQ ID NO: 42734 - protein, 63 aa, A.fumigatus
GFSVTNVECSQVVENLVIESDNLMPNVVEFGSDNYIRWGRKNISNKRDNKVRHALSSYVRCAN

SEQ ID NO: 42735 - protein, 172 aa, A.fumigatus
ILLHLFKVLFPSEFLHLGPFQLHVLVFSLLGIRLHLTLDSRVECAKDTSCQEGSVDAVVDSYRRDGNTCTDDGLVGCPQNGKYDKRKEDNIPLGIWTMLYRLSTPSSELPLTGTPMTGRTVCAAAIPGRWAAPPAAAIMTLMPRAAALAEYSAMNVGVRWAEVMSTAGSMPK

SEQ ID NO: 42736 - protein, 60 aa, A.fumigatus
ASHMAVVGANLFRRGVTGVQNIDLDIKSVRRLNKHSSQLTSTEDPHLWRVPHFNKTGNEG

SEQ ID NO: 42737 - protein, 149 aa, A.fumigatus
KVCPDEKKPTSSSAAKFGPGHKVIPTELIEIGDIVVLHPGDKVSADGVVIRGESYVDESMITGEALPIYKKKGSTVIAGTVNGTSSIDFKVTRTGKDTQLSQIVKLVQDAQTSRASIQRVADIVAGYFVPAIISLGLITFFGWMFISHV

SEQ ID NO: 42738 - protein, 405 aa, A.fumigatus
SHPPQIFVAEGSGGKVMVCLKLCISVIVFACPCALGLSTPTAVMVGTGVGAQQGILVKGGAVLEGATKINHVVFDKTGTLTTGKMTVAEARIERQWLEGRRRLWWLIVGLAEMNSEHPIGKAILSAAKAESGHSESDGLPGSLGDFNAHVGKGISALIEPAFNGERTRYRAVIGNAAFLRSQGVSVPESVEAEDQLTGSPKPTASITQIHVAIDHQFAGTIFLRDTVKSTAVATIAALHRMGLKTSLITGDTRSTALSIASVVGIPSEFVHASASPSDKQSIIASMQESGDRVAMVGDGINDSPALATASIGIALASGTDVAMEAADIVLMRPDDLLSVPASLSLSRAVFRRIKLNLMWACLYNVIAFHFAMVSSCPLAALCFPPWPPARQWQHQASPSSSAACS

SEQ ID NO: 42739 - protein, 91 aa, A.fumigatus
TPTMAMSLYRQWSLSFDYLCFTLCMFLGCFVSRALFIARIRLMKYLYDGWLSTAIITMNDINIYGLRGPYRCSLIRLSLQLHRWYHAKIQG

SEQ ID NO: 42740 - protein, 88 aa, A.fumigatus
ESGSNISFTVSAILLGTHLQVGLHRSDSLVATEFLCGSSTLFGDVSGVTTVLLSERKESADSLLVYYRPQKVSGYPELLTYKLNLQSG

SEQ ID NO: 42741 - protein, 174 aa, A.fumigatus
PLEQTNSNLLSFIASLVKMWNSPKVGVLGGGQLGRMLVESANRLNIQVNVLDAGNAPAKQISAHDGHVTGSFKDREAVRTLARTCDVVTAEIEHVDTYALEEISAEVKVEPSWQAIRTIQNKFNQKEHLRKYGIPMAEHRELLENTPAELAQIGEQLGYPLMLKSKTMAYDGRG

SEQ ID NO: 42742 - protein, 70 aa, A.fumigatus
SVIRTGVPVATVGINNSINAALLAARILGTFDPAIQRKVEAYAEQAKHENMELKGTKMQELGWEKYFEQM

SEQ ID NO: 42743 - protein, 157 aa, A.fumigatus
SPVRPRQSITLSRSLQTHQAQSHVGLPLQRHRLPFRHGLFLPFGGFMLPPMAAGAAMAASSVSVVVSSLLLKFWKRPRWMDAEKLEKAAQFGSAGPYGSRKKWWAAALVSGPGSRPSWLDWARRTGARVWSTVTGRNPRTIDTNDGYVPLQAVEPVV

SEQ ID NO: 42744 - protein, 349 aa, A.fumigatus
ELAVMVVKTKDAVLSYPTVETVQEDSICKLVYAPARNVSDAINQKAQELARKAVAAFDGKGAFGVEMFLLEDDSIMLCEIASRIHNSGHYTIEGCTLSQFDAHLRAILDLPIPPQSLEIRQPSIMLNIIGGAAPDTHLKAAEAALSIPNASIHLYSKGAAKPGRKMGHVTVTASTMHEAEKYIQPLIDVVDEIRSKRSDIKTQPVKSGPSKPAPTVAVMMGSDSDLKTLVPGLKLLRDYFGIEPAVDITSAHRTPTFMAEYSASAAARGIKVIIAAAGGAAHLPGMAAAHTVLPVIGVPVKGSSLDGVDSLYSIVQMPRGMLSSFLLSYFPFCGQPTNPSSVQVFPSRR

SEQ ID NO: 42745 - protein, 1253 aa, A.fumigatus
LFVQQDEIFVYDRRFVSEPENVELPELPSPEPFTPDTPPDTLTNQNDLQAWRNLYMARRSWALGLVERCGAMDKSIHEHNERTDIIHRAAGVALENLKTHVGNLENRFQEAQTWANDLLKEQRAALDGWQRALTTLESIPAPKVFPFLGRPSTPKEHRDRPTGTLRDFVDANEVQKAGAEAAAESSRFARQIDDVAEAVRGITADTQRLIDDQLPSGADAADGLQEMITIAKKISSDYEHVIALPNNQKTLANISRLALTHTQDLLPSMLDISAEIHAGLEEAVRRHNTAMKVALDHMRTISAIELRLADVQSQIINLNVQSDAFDVVFSVYHMPMVYGSILVESVRRREFNEKMKADSLTLAEEMAVFRDEEQRRRKKWLKSMGDFISLTETTTPGVEINLQGLDYEWPEVSRNDIESYIEHLKSRPAMASLADGLTQQYKDLDAPTRHQRRRAKAFKQGSIFDLSRSSLLLRSDDMLRSLREEKSKLEEKLKGSESRIRKLEDLLHRQSQLSRPVSGNFNLEFPSSPASPYPDELSRRSSVSSRRMSANQSSEDKTLAQRIVTLEAELNAERETVQRLQKEAHAERLSNTDKIQEAQSTKRDLIDNLEARQREFDEERRYLEGELKKYRLRTEELEEELDRITDSRDHAKQDADERINQLETELQNLHIHTEEELHRANDLLEQMQAQKMTEESLQQRINELEKQQSEIKATEQENLQTLQAAFMNLSPGGAVPAEIPSIIKAIEVLSEGLSIHVKNAEEKMAEAVAENKALEERMNQLETEVQDAKQSAEQRESELAQVRGELAQEKEKLAAVQSELHDERSKLNALQSQHADGDTGTDALRQRVVEDERKLGILSQRLAEVEAQARESEKEVCAWKNKLKAISESEREATTRIEIRGSRAKELSQQLFEQVEKMEHMLEQLGFTVIRQDGEIVVQRASKVNASSGIGDSLAQSGVVSVKPDPSLLDWMQAETAQEETDRYMAFLESLYQFDVDVFGDAVVKRVKDIELLARKWQKEARGYRDKYHRMQSEAHDKIAYRSFKEGDLALFLPTRNQAIRSWAAFNVGAPHYFLREQDAHKLQTRDWLLARITKIEERVVDLSKSMNGAHPDRRSIGGTSDAASIDDENPFELSDGLRWYLLDANEEKPGAPATPGLGKSTVAPAHVDARGSIRLKRTSNGGNVAKTLTKSLDSRRNSSSSKKGPPFAISQRANESTAELARPAEANTPVSPSAQEAASTPEEVRRDQLQGP

SEQ ID NO: 42746 - protein, 551 aa, A.fumigatus
  UNSURE (188): Identity of amino acid sequences at the above locations are unknown.
RDYHPFTRGASLFVVMPTPERNTDRLPSSRRIYEQRSPFSRARGNSRAAEDFDASRIPSPSYKYTTQRRTNFNETNTLTGAFRKAGRYATMAENEGISASVPYTRGTPSPGRRRNIYNAQSPESNPPNELAEAYRQIDDADSLVDLEPEDVYDRGDKIGRSSGYYARDYDVSTTSDASFLPEIQDESXRRRLSDRIQDEKRLRRATTSHSPVLSNRGGTKNALTAENLQRREEEDQLLSGDDDTFQRGLNVPSNWGSRAKRNSDWLRKLKRRDEPEPEPEPEPQQRPEPPANVSPPVKKLNFDFRTSPGRSLEPASSRYSRIPLSDARNKLSSEHKEDKAIGGTSEPIANTPVIVYKNSSFTKPSPSKRDSHDLLRRLARRESPDQNRNEQELRTPEAPKGGQRRIYDKTPVVTGAWIDTPMTERISERTTEMSEKLTNGSMPQVASNEPNPVIPPVQEAEAEVKGLEQETDGDKERDKQEQLERGGERGLEKAKMEEGQEKARNENEEKDKEAKKQEEQEEKTKEREKKMKPSLIKPDLPKSALESVIQE

SEQ ID NO: 42747 - protein, 195 aa, A.fumigatus
SCMTDSRALFGRSGLMSDGFIFFSRSLVFSSCSSCFFASLSFSSFSFLAFSWPSSIFAFSSPLSPPLSSCSCLSLSLSPSVSCSSPLTSASASCTGGITGFGSFDATWGMEPFVSFSDISVVRSEMRSVMGVSIQAPVTTGVLSYIRRWPPFGASGVLNSCSFRFWSGLSRRASLRSKSCESRFEGLGLVKLEFL

SEQ ID NO: 42748 - protein, 390 aa, A.fumigatus
QGKYLTHLAYIALKPLYRGTPPTPDLQQDHITMTKSARRSGKGKASASRSASSSGSSTPSSQAGPLPPFSKAPAALRPFLEPLSPQEVYLIHIDTSPPDLKKQTFIVPAIINVVIVAIFALRIYMVRNTYPAMIATVIGLTSSAAVDTSRLSSAETSSLIIRRTFSLMIDYFLITVFLSWPIRFIRGPVQWRRRIGFQGREIIVRRSQRTLSQTLERNRWIRDNDEARDKIVAAITPDRIRKTGYLLVDADWDLDYDAMIKAHEMVDPARKDDRVALSEFRTAVLVNTDADGWLIWRVEDEDTAEARKRSAQSDQILAFKDKLTAMGKEDLFFRWVELIQYESTQPGGFTPERQRSAMLQAKELFERENVDFARFWQEVGGMEGFSDQLD

SEQ ID NO: 42749 - protein, 95 aa, A.fumigatus
GDSYITSNSSSLPRRETSDGAFPGICHHLDDHVARHCRTFHDFYRDRSLPAEDFDCRIYRGSGSDASRAWGCDCLFLSFFWDSDCNVALEKPAAF

SEQ ID NO: 42750 - protein, 62 aa, A.fumigatus
DRPIPGFGKRKDVDSSIIAKQCYNCQGLGHVQADCPTLRLNGGANGRCYNCNQPGHLAVRRC

SEQ ID NO: 42751 - protein, 94 aa, A.fumigatus
IKALADILKGHISRDCTAPNGGPLSSAGKVCYKCSQAGHISRDCPNNDAANQQPAESATAPAAAAAAPAATTVTAEVSAEAAPVPAPAPTAAVA

SEQ ID NO: 42752 - protein, 124 aa, A.fumigatus
GKPILTPPFCIRGLRNSVLISFLSFLFFFFPLSQFFHCIYYAPGFRFLSTGLFYNYYVYDEQKFHDVPRFLTTWILHMAQGYHDWRLLFSPGIFLIYHMVRQGKKETWRGERLIERRRDIGGPE

SEQ ID NO: 42753 - protein, 160 aa, A.fumigatus
LLSSGFQSMSISEVFGEFRCGKTQLSHTMSVVAQLPKEMGGADGKVAYIDTEGTFRPERIAQIAERFSVDPDSAQENIAYARALNSEHQLELLNTLSREFAGGEYRLLIIDSIMNCFRVDYCGRGELADRQQKLNQFLMRLAHMAEGLSLSISFTELYRN

SEQ ID NO: 42754 - protein, 152 aa, A.fumigatus
VGLLRTSLLNSLLTRDTTGIKAVRKLAEMPPYPNAVKEAAFGGVAELEKKRQYRATDNVREQDAYGMVFDKGEARRRPVSRERRYSRSPKRSSRRDSRSPKRGLHRNRYRDRSDSRSPRREDSYRDRNRERSYNDERRDRRDDDRYRERRRR

SEQ ID NO: 42755 - protein, 65 aa, A.fumigatus
SVKLGLQMVCPTLKDTEAQRAIQGARIETTRADIYIIRRTGSVKPAKNNSTKKINGFVFLAVNGW

SEQ ID NO: 42756 - protein, 266 aa, A.fumigatus
DLLINMAVAIKETVSNFMERFHGHPENLPREPSAEEFQQLRKKYTDAGQGHVFAFVDELQTGERSQLFHQLSSFDPVRINELADKALNPPKADDGPASLEPLPDIATASILDSDPKDLEQWYEEGLKLVAGNKVAVVLMAGGQGTRLGSSAPKGCFDIGLPSHKSLFQIQAERIAKLQLLAQRISGKEAVIPWYVMTSGPTRKPTEEFFEQHKYFGLNKSDVIIFEQGVLPCISNEGKILMESKFKVRLQSHTNTVLRLLGSDMEK

SEQ ID NO: 42757 - protein, 257 aa, A.fumigatus
VAVAPDGNGGIYQALLTSGVREDMRKRGIEHIHTYCVDNCLVKVADPVFIGFAASKQVDIATKVVRKRNATESVGLILQKNGKPDVVEYSEIDKETAEAKDPKQPDVLKFRAANIVNHYYSFKFFESIELWAHKLPHHVARKKIPCIKEGTGEFFKPEKPNGIKLEQFVFDVFPMTPLEKFACIEVRREDEFSPLKNARGTGEDDPDTSKRDIMSQGQRWIEKAGGIVITEGDVVGVEVSPLISYVSSSLPLHFRSF

SEQ ID NO: 42758 - protein, 85 aa, A.fumigatus
VALQRNCPAPASGAGRGVGAPRGGFNGGFRGGYGGYPRAATCYKCGGPNHFARDCQAHAMKCYACGKLVSALTCRCLKSKRWLTF

SEQ ID NO: 42759 - protein, 87 aa, A.fumigatus
TNQVQSDPGASALFAGADGRKPVGGHVLAHASTTRVLLRKGRGEERVAKIQDSPGLSRSDTLSRTSLTIYRLPRARSDLCDYQRWYQ

SEQ ID NO: 42760 - protein, 69 aa, A.fumigatus
PSLYSTNVGIARIFISCATERTLSTSTWINRTLEYFSLSSPTLGATARQGPHHVAKKSTTTGPDEVSAL

SEQ ID NO: 42761 - protein, 84 aa, A.fumigatus
GHSHHKYDTMSKRAADASEEHSAALKAGERPVADDIPDEVGEFEDEFEDEFESEDEILEAGVDGRPDAEREEEEKGLLANLSVA

SEQ ID NO: 42762 - protein, 433 aa, A.fumigatus
IVTDRNAMTTDAMEVDKQTFIPGRTKLAPGEVLSPDPSTYDMLHTLSTPWPCLSFDIVRDSLGDNRKTYPATVYAVSGTQAAGGRAKENELLVIKMSGLSKMEKENETDSESDSDSDDDSDEPILESKSIPLGSTTNRIRAHQTPSQSADYSRPPQTITATMLENSQVVIHDVTPHLTSFDVPGTVLSPSASKPLSTLRMHKSEGYALDWSPLQPLGKLLTGDNDGLIYVTTRTEGGGWVTDTRPFTGHTSSVEELQWSPNERNVFASASSDGSVKVWDVRSKSRKPAVDVKVSNTDVNVMSWSKQTFHLLATGADDGQWAVWDLRHWKPNASAPSSQIKASPVAAFDFHREPVTSIEWHPTDDSVVAVGSADNTVTLWDLAVELDEEENREAGLAEVPPQLLFVHYMESVKEIHWQAQMPGTIMATGSSGFG

SEQ ID NO: 42763 - protein, 153 aa, A.fumigatus
NVCPYLITAKQPGNTDVNIASQADADSIASCHTVRGSVTMASSVSGAVNLHGVETIQGPLTARGASDLSALIASDLKTITGTLTVANNDALNQISMSNLQTVGGDFKVENNRNLKDLSLSDLDEIRGGVTVSGELNRFVLVYSSCISHRPDEA

SEQ ID NO: 42764 - protein, 232 aa, A.fumigatus
TDICDSRSHFSTEVPRRALEVPMVLKAILALAARLDAILSGASDWEAAEYHGQCLELLIAALAQPEDTYDDNLLITVVILRIYEELESSNDEKYHLFGSNRLLNTMSRSASSGGLAEAVSWQFLRQAIYASVVQYQPMQLDLENYERSAVFHRRDDAAYANVIIYLCARILQGGGAYTRGMDEETWRQLSDSVEQWHREKPVSWQPLKYKPANIAENRPFPEIWMMSPPAGM

SEQ ID NO: 42765 - protein, 229 aa, A.fumigatus
  UNSURE (116): Identity of amino acid sequences at the above locations are unknown.
IGSFWYILLVFRTDLTRRRISLSNLDTVWGPTVIHSSGTFNCSSLDSKLSGEDRVFQSSYSCTTGKSNKSSGSDGLSTGAKAGIAVAVVIVVLLILFFLWLLIRRRKPPTESTDRXDSDGRYRISNTSSHGPRIQHRKADFNAHAAPRGRREGYPPKASVPPTSGRQEVLCSSILAPGIGEVVCSCIITSWVQSISVFGFCVPPKSHVRPLAIFTSYRTFSATASTVGD

SEQ ID NO: 42766 - protein, 62 aa, A.fumigatus
LLTQWFQIRIPECATATLSRLGLAVVKVPIEPPPEHLRFSELSLDISILFYRSDPILLSLLP

SEQ ID NO: 42767 - protein, 77 aa, A.fumigatus
VCTRFQLGRHTDWLELEQNHCSITQQLADITKTYSSNSTIALVLAATESEGLTWLRDYCRDQYVIFVPPVSSNQDIC

SEQ ID NO: 42768 - protein, 120 aa, A.fumigatus
ALLVPGEVPRSKNENVSRRCQSIDVRTYYHYTIYEGSLYTQGAILEMNERNKYASREDSFGELIARGLIGLQEDVCSVQTVDAKGDTMLFSAVGEMAVDEGSISWVSSGIDGVGAGRSSG

SEQ ID NO: 42769 - protein, 346 aa, A.fumigatus
ESLPATGSSATRSVSASLVLPARSCDRRINGRCIISGRGVIRNKLIICDMDVPQPVPGVPDVAETGRQQNLEISGPELAATGESMGPPEFHNGYSSDSRAHYTSHNGGFDSPSTHVSRNQENDQSRVTESPTLTQQPRPPSSSRPGSGLSSGPEQRQGISQTSQDVSQRPPSQPTKNSVVIKVGMVGDAQIGKTSLMVKYVEGSWDEDYIQTLGMLFFWTCALLILTLSTGVNFMEKTISIRNTEITFSIWDLGGQREFVNMLPLVCNDAVAILFMFDLTRKSTLNSIKEWYRQGRGFNKTAIPFLVGTKYDHFVNFPREDQEEISIQVGKLTREDDKQCANDFSG

SEQ ID NO: 42770 - protein, 256 aa, A.fumigatus
PGCGITAVTSTSYSSLQFLQTKTYADIGQNSDAIPFIYTTDRKPVPHLLVPHTTRGREAAAYLSYVVDFYDQLPPYTIFIHSNQDQWHNDLFGPKTNVALRNLRFEAIAAQGYVNLRCEHEPGCPTNVHPWSPTQIDIDKKDIRAYFPQVYQTLFGVGKERVPEHIGNICCAQFAVSRERILQRPKRDYERMLAWAAETDLTDSFGVGWVFEKVWHVVFGMEDIYCPRFEQCRCDVYGWCGPLANGETLQAVRVKS

SEQ ID NO: 42771 - protein, 90 aa, A.fumigatus
CKNSEGSDVTLRWDAEAEDTDGLDPGSNDTGTDNLPDPGSKDAGTEDLLSAAGGGDTGFRGIPLSTSSWGGVSVEVSFSVLDSWPVGAGV

SEQ ID NO: 42772 - protein, 102 aa, A.fumigatus
LTLFSPVIYKALTSSGPVVVDFFATWCGPCRAVAPKVGELSEKYSNVRFIQVDVDKVRSVAQEMNIRAMPTFVLYKDGQPLEKRVVGGNVRELEEMIKSISA

SEQ ID NO: 42773 - protein, 566 aa, A.fumigatus
  UNSURE (558): Identity of amino acid sequences at the above locations are unknown.
ISGLTSHSSTYYLFILFLPVRLGGSSFLNVVVACVLEGVLAYYYLLSYSLSLVYALIASCKTEDMAEETPVLTIQERIKALKLAGSQPTPFLRAQTINNPPANGHGSVLEHSVIGNEPGAPPTQAPRSPSTGPSIALKSKVPPPLPTRKASNQQLAPSLPPRRPSVNSIESAASDTSRSTVSTSVGRPVPGRSSSSGESGNVHTVRAPRYDEAELPVLPPRREEEKSPKAPPRPKPTMLKSRDGLPPSLPSIREPPSLPSARPVLPIRRASSNVNLKNGDAAPLPPPRIPSRDSQGQSPSAEGESKPARKLPPPPPSGSALGKLHQSGFGGLNKTAHSTLNGAPPPIPIASKPEKPDLSKLLATKPRVERNTTNTEPTAMCLKCRDFSGPDSHAARFPRESLPTHDLAWLARELTAPFPSPTDKARALFTWCHHNICYDVDAFFNNCVKPSTPASTLASGVAVCEGYAGLFAALATHAGLEAIVIGGHGKGYGYRALGPGQSIPPYSAGHAWNAVRIDNGQWKLIDVCWGAGVVQGPGQPYKKLFNPTMFTMTIEEFXGKHYSEGK

SEQ ID NO: 42774 - protein, 192 aa, A.fumigatus
PVRHIRPSSFFKPRHMLILGKTATPSPSSTPPTANPFRTSSSPTPPAAAKQPPTSPTSSTSTTNFPLTPSSSTPIKTNGTTTSLAPKPTSRCAISALRPSLHRATSTSAANTNQAAQQMCTPGPQRRLISIRRISARTFPRCTRRCLGLARSVSPSILGISVARSLPSAGNGSCSARSGTMNGCWHGRRRRT

SEQ ID NO: 42775 - protein, 69 aa, A.fumigatus
LLWAVHYFMLNCTAYSSTHHIGVFPSNSRTHLLLHHSSVSIMDYTRIILALAVYIGKHSRPSFPRNPSH

SEQ ID NO: 42776 - protein, 64 aa, A.fumigatus
AVFSPHRTDHLAILTAAAIVPSYLQLSFHRAQLVKIIQNHNRLAAKTSTPRSRHEQAIEGLLDI

SEQ ID NO: 42777 - protein, 118 aa, A.fumigatus
IGLLHCLTMALVQYPPPVDYAAQLNAFKDFLQHFKTFESASEAAATEAIEDLHIDGDATSDEYDFMDDVENENGQQGTRARRGRREPKLKYMQILQDIADRERSNVLIELDDLATVRL

SEQ ID NO: 42778 - protein, 207 aa, A.fumigatus
FGMSQSRDLSSRPGRSNAGSIRSGRDVAARTYTPERPSAPSICVRSWLTTRSVTPVESWPRLGAILSNSSKKRMHGRAAWARSNRSRTLFSLAPIYLFRISGPLTLMKFRPHSPAIALARRVFPHPGKPYRSKPERKRRGHCAKIGAYLVGYCKVSSSIFRVSCRPPIAENVVVEDVSVTLRRDAGVNPLMAFSKSSAPRVTALDAA

SEQ ID NO: 42779 - protein, 712 aa, A.fumigatus
  UNSURE (451): Identity of amino acid sequences at the above locations are unknown.
SFHLTAYSFKDDVLDVIMSQREKRNEAMAMAAEADMDAAAAPSMFPPELTRRYTLNFKPLTPSGSSSDRYSKALAVRNVRAEHLGSLITVRGITTRVSDVKPSVQINAYTCDRCGCEVFQPVTTKQFLPMTECLSEECKQNNSKGQLFLSTRASKFVPFQEVKIQEMADQVPVGHIPRTLTIHCHGSLTRQLNPGDVVDVAGIFLPTPYTGFRAIRAGLLTDTYLEAQHITHHKKSYNDLTMDSQTLRKIEQYQKSGNMYEYLSRSIAPEIYGHLDVKKALLLLLIGGVTKEMGDGMHIRGDINICLMGDPGVAKSQLLKYIAKVAPRGVYTTGRGSSGVGLTAAVMRDPVTDEMVLEGGALVLADNGICCIDEFDKMDDADRTAIHEVMEQQTISISKAGITTTLNAVTSISGCSHSFFMDGTTREFFPVENITFPAALLSRFDVMFFIXDTPQREADEELANHVAYVHMHNKHPEVDDAGVLFTPNEVRQYIAKARTYRPVVPSSVSDYMVGAYVRMRKQQKSDEASKKQFSHVTPRTLLGVVRLSQALARLRFSEEVIREDVDEALRLIEVSKASLANDGHSGIDQSPSSKIYNLIRGMRESGAAAVGDGEEGELSMRRIRERVLAKGFTEDQLTMAIDEYEELNVRVVSLNSPWWLLLMSLFLCRFGKSLTTELASFSWISEAMRQWTYNRPANGCSLDWQKVITVVC

SEQ ID NO: 42780 - protein, 108 aa, A.fumigatus
TTFQTSTTTATKMKNLSILTSLLLTSASLVFSSSIPPKCGTCNPLSGENHCDITNLLHQHRHSLPLRLPCRLQGLEGQPRRQQTVPSECPQLPVPGLHPRKHRVQHPL

SEQ ID NO: 42781 - protein, 68 aa, A.fumigatus
VTAPEDGAQKTLEHSRCRTRSFEELSIEIASVTCLTAGSCQHCTSPSPKTPGFDFTPSNLVARLPKMS

SEQ ID NO: 42782 - protein, 1080 aa, A.fumigatus
MIASADNTLPIVIELHANFLELNLLSQIRALPNPTYSSAQSEHMHPLALHLSPTSTANIITTSLTPAPSNTSPFVKIAPDAEVIVAPKVRPKSASRGPRGDSRSVNGSSRKSVGGRSSGSTVRPKSGRDSTSRGALFFRGVDRRLVEPYFDEEFEDDTNEGFRVWVDPDMLATSELRGASWVCIAVVQPAGLKAPPDPQQQMNQAEQKASEAGLPATNLVARLAPWVDSPDSQHIAMSTMLCSALGAEGMVGGIIRVEAAPPQLQPSIVRTLKIYPFMSDSAKKKDGLKFGSDTAAAKDALLERIKVIYGSTGTDKGLLSGPLTEGMILPRFENPTVSAFDGAIVRFDPPLKSSPDGPKQMLGWVLGSEAKLSLEVQAEIPRPAEQGQLSFPTEEPLPNSIPEMVGIDQVISQSLDNLTKSSSVLVTGGLGSGKTALTHLLAHRLRKDHLFNVKYFSCRKLVTDETRISNIKETLNRLFMSASWCARLGGQSVVILDDLDKLCPVETELQVGGDNGRSRQNSEVICSMGREYCSMNSSVVLLATAQSKESLNNVIIGGHVVREIIHLRAPDKEGRRKVLEKLTSHDRASTSLTNGHARTASASTQDSWLDPSNPGSRPSSAGADGFVLARDIDFLDLAGKTDGYMPGDLVLLVARARNEALIRSVRDPQAASKAVTLGAEDFENAIRGFTPASLRNVTLTSSTTTFSAIGGLHETRKMLLETLQYPTKYAPIFAQCPLRLRSGLLLYGFPGCGKTLLASAIAGECGLNFISVKGPEILNKYIGASEKSVRDLFERAQAARPCILFFDEFDSIAPKRGHDSTGVTDRVVNQLLTQMDGAEGLSGVYVLAATSRPDLIDPALLRPGRLDKSLLCDMPNHSDRLDIIRAVSTKLVMDAEVAARMDEIAARTDGFSGADLQAVVYNAHLEAVHDALGDHSGTNDKSTAKSSSKPTSSTSSKSFIQFLYSTPEQRASAVSLPPPAVVAAKIEAIKNARRRQRQIEQGTTSAAPTTNGATTEEAPREEIVVRWEHMERSLSNTRCSLSENERRRLQAIYREFVEGRNGEMPNGEAGREIGGRTSLM

SEQ ID NO: 42783 - protein, 117 aa, A.fumigatus
RTSPSSPLSSSPPPPSSSPPVFPPSAEPATRSPARTTATLPTFCINTGTRFHCACRAGYKASKDNHDVSKQFRLNVPNYQFLVFTPESTECNTLCDNPYGASPDLCAEVPIQDKCAI

SEQ ID NO: 42784 - protein, 82 aa, A.fumigatus
EPPRTIQADNTYIKLFVFVDRHCELILCEAFGKNAFPNPSHAKFTLFTVPNSGSTALAHTANEIVDLATGALVYAGMTVIGQ

SEQ ID NO: 42785 - protein, 63 aa, A.fumigatus
QRTQGLTCLVSQNIYQGLQLYVLGKFQLEKLCCHVQNYRITCNYVVAPVVLLLGKHPIVEQYH

SEQ ID NO: 42786 - protein, 207 aa, A.fumigatus
GRVPNGVKVQRVVFCPPWARNSPDWLRPWHLGSQSGKAAAQTDESDKTSKESQACEQLSQALGGVTIIQKGPHDVISNGVTTLISDLKGGLKRSGGQGDTLTGSLGTLLAWRAAYHNKLWDSGEQENPKEAQSKQDVLAELESENKRMSPATTLLLVAWAGSGITRECSRRAFNAKGRSLQASDLTDEVHESFLELIGEPEASRTHL

SEQ ID NO: 42787 - protein, 219 aa, A.fumigatus
  UNSURE (41): Identity of amino acid sequences at the above locations are unknown.
RTSFGVNKTPASSTSGCLLCMWTYATWLANSSSASRCGVSXMKNMTSKRESNAAGKVMFSTGKNSRVVPSIKKEWLQPEMEVTAFRVVVMPALEMEMVCCSITSWIAVRSASSILSNSSIQQMPLSAKTRAPPSSTISSVTGSLITAAVRPTPLLPRPVVYTPRGATLAIYFSNCDLATPGSPIRQILMSPRICMPSPISFVTPPISRRSKAFFTSRWP

SEQ ID NO: 42788 - protein, 214 aa, A.fumigatus
TVIYIDADTKRQYTYQDVKETALAFGNGLKAVLDWKKGDVLALFTPNCIDTPAVMWGTHWAGGVVSPANPAYTVEELAFQLKNSGAKALITQMALLPVARAAAKQAGITEDRIILIGDERDSQAKFKHFSSIRNISGATRYRKTKINPATDLAFLVYSSGTTGVPKGVMLSHRNIVANSLQLAAGEAKQLSWNGGADGKGDRILAFLPFYHIYG

SEQ ID NO: 42789 - protein, 78 aa, A.fumigatus
WLAANMVVSSFAIGVLGKSLFDLGFVDAILTCLFFNLLGVLTVCFFSCFGAAFGLRQMVLSRFWFGWGPTKFSMYFFA

SEQ ID NO: 42790 - protein, 422 aa, A.fumigatus
PFASSHASVLPSGYGRWCFRGSGSAGGPPSSVCIFLHNLTYCLFKVAGADILVPSVAILNVLACVGWSAANAIVGAQLINAVNGNVPGFAAILIIAICTFVITFAGYKVVHAYEYWSWIPTFIVFMIVLGTFAHSGDFRNLPMEVGTSEMGGVLSFGSTVYGFATGWTSYAADYTVYQPANRSRRKIFLSAWIGLIIPLLFCQMLGIAVMTATGIDDGNNKYQMGYDASGNGGLLNAVLEPLGGFGKFCLVILALSIIANNCPNIYSVALTLQVLSRYSQRVPRFVWVFLGSCASVAIAIPGYSHFETVLENFMNFIAYWLSIYSGIALTDHFLFKRGFGGYRPEIYDKRDKLPLGIAASIAFGFGVAGMITGMSQSWWVGPIALHAGQAPFGGDVGFELGFAFSAVMYAVLRPIEIKIFGR

SEQ ID NO: 42791 - protein, 239 aa, A.fumigatus
SFFFSFFSSRAADWADDEEFDDPSALPAQQVTTNKDGTKTVVSYRFNDEGKKVKVTRRIKTTVVREHVNPQVAERRSWAKFGLEKGHAAGPSFDTTSVGENIVFRPSVNWRVQAAEAEKAGPEKGSIKDQLKDKKVKCRICSGEHFTARCPFKDTMAPVDETAAAGAEPGADDVPAAGGLGAGTSSYVPPHLRKGAAAGGERMAGKYEKDDLATLRVTNVSFTSCPSALHPSIIFWNKY

SEQ ID NO: 42792 - protein, 191 aa, A.fumigatus
VSELAEESELRDLFERFGRVTRVFLARDRETQRAKGFAFISFADRTDAARACEKMDGCTFSSPLASFFLSFYEIQLLISFPFCSWLPSFDPPRRVRKEGDLNSCFLISFHGPWVFSSGRARFMTRDLPPFSLYCMTRSIMMIIRRHASCGLLARGARPLDTKKSYRFRGFIFSPFSSEWKRPKMRKSCHSL

SEQ ID NO: 42793 - protein, 81 aa, A.fumigatus
PLFCPPATLLQSPFLEGSVTSDSDYTGAPRQFAGPTGFSMDDEDNRRRNGAIGPSLAQSVSIPATNGLRYSTQQSAMQDVA

SEQ ID NO: 42794 - protein, 405 aa, A.fumigatus
RLSLMLYASFQGHFLLHQALSIHIQPARHTRECRTFGHNVCLHCRSSLLPVNTPSVEAILMILTSPPSQPPPGLSSALQSQGQGLSSSSSILGRHENYAAQYALQRGSTCPSLSSLSEMSRISSYTSTPRGLDHSFDAPHNLFFGQTGNIYMDSQQRLPQPVADAPPFHETDILLPIVAGSQAIKPDIHAKIHKGFFQVDDKWTCYRRNYFSVSCSFSLHPWTRAPLYLKLSDQTTERILKFSMCISAVVNAQYGETRELVQHTPKRDKQSERKPGKVVLQPCQPPPPLLLNHGAANSGGGQHAFALNSQSAALSMDYSSSYTGAPQQSQPPTQHTFERIQFQKATANNGKRRAQQQYYNLVVELYAEITNPNNGSETQWMKVARKLSHPMVVRGRSPGHYKDGS

SEQ ID NO: 42795 - protein, 80 aa, A.fumigatus
DYAKKYILNLVGPQPNQNLESTICRNPKAAPKHEKKQTVKTPKRLKKRQVRIASTKPRSKSDFPRTPMAKELTTMLAASH

SEQ ID NO: 42796 - protein, 76 aa, A.fumigatus
PGVPRIAIYKGFPRHSTIAATVERPLLYLGGFLKVVLNATEHYDGRGAIAPCLNLVEKTESIPTTWGGEMKLMIRV

SEQ ID NO: 42797 - protein, 284 aa, A.fumigatus
QRSGKRSMPILHEHFAPGSQIKEMQAHTDMVTAIDFDYPFGTMVSAALDDTVRVWDLNTGRCTGFLEGHNASVRCLQVEDNIVATGSMDASVKLWDLSRARTVTRDNRLNKPSEGEGEDDNASDAFSLFSATTLEDCYVFSLDAHVDEVTALHFRGNTLISGSADKTLRQWDLVKGRCVQTLDVLWAAAQASTLAADTQWRPSGRLPDASADFVGALQCFDAALACGTADGMVRLWDLRSGQVHRSLVGHTGPITCLQFDEVHLVTGSQDRSIRVSLLSVCLFS

SEQ ID NO: 42798 - protein, 93 aa, A.fumigatus
LQIWDLRMGSIFDAYAYDKPITSMMFDTKRIVAAAGENVVKVYDKADGHHWDCGAGVGADESGPAPATVERVRLKDGYLLEGRKDGTVAAWTC

SEQ ID NO: 42799 - protein, 61 aa, A.fumigatus
FLYLSAHLPTGLIFCGSMIGVYLTYKELWVSEGALKAEIPPYYNRNASSSFFSFSKLLCII

SEQ ID NO: 42800 - protein, 105 aa, A.fumigatus
GIDSPSCSCRIFVLTTFCDQEMDIVNVDFEWFDPQPAVDFHGLKNLLRQLFDADSQIFDLSALTDLILAQPLLGSTVKVDGNESDPYAFLTVLNLQEHKVLPLVL

SEQ ID NO: 42801 - protein, 214 aa, A.fumigatus
CMLILLQHVQSRHIEAFGRKVTSTAGHLMGPITDSSNGSHYHTAMADIHRELRRPTTQRKVFSLTQTSPTDLVRSKLSTSEIQSRALSSVPDELLANIPEDSSSYSLFEGFKATQDDHEFRKAHRRRSSKGKKLLKDGEAAGALPSAPTDLKKERDLLSRRLDLMGVRKNMCSSEIHEIDNKIANLHNIRKIVLDRLAALEMEEAELEHQCGLW

SEQ ID NO: 42802 - protein, 80 aa, A.fumigatus
LGRFGRRGFGCVFHVRIHLSETTFTFSKESETAFYKYCLSKLVTLPSAANNAQGNARCLSYTNTSRPDHRSRKCKPILTW

SEQ ID NO: 42803 - protein, 207 aa, A.fumigatus
TCKSTRYFHLFFEDREELGLLVQDKPVIKDLTSYLQRKASSNPSLAPLSQLLSQSPIPPIGLILTERLINMPAEVVPPMYNMLLEEIAWAIEDKEPYNFSHYLIVSKTYEEVESKLDMEESRPQKKKKKSGSNVERFFFHPEDEVFERHAICSGSIEYTHKHDDGLSDSKRAFQDLGIKTSGSLILIDGPKLEAAVKDVTDYVKPPV

SEQ ID NO: 42804 - protein, 753 aa, A.fumigatus
FLFQLTSHRKRYTAVQSHLKQMPPKRTRRAGAAARSEASIIFGHSSPSVSNQPLPDVPTQPSWAYGSPAAPVLPRRLVAKDIGLAEVAESIDQTIRDAEKRDRRNDPDEANDTDDRPHMNTRSRRRPSAANASPVRRRTKREPTPDQVQLLDALREATVSPNQRNGENETQAERSTATPTPPIPHTLSTMSSPTSQILPDPKYPSLPIEQLYPSPLQRIGSPTRNDASLEMSQNTGIDDNESVISWMVERDIHDDDLQRTRSARYRREPVGKNITAPPRRFSGLAFANETIVEEDEPDSRLSVSKTPQESTVESEAQSDHQTESDQPLVSLEPQKEPPPQVEEVSSAPARTIIPNFFTKDQSFNNSTTQPSDQSFTDHARSTAADSFIPRISVSLPWTQILRLSGAILLTAISLLTIYSFSDSIANIPHDIASHFPFRNPAPSISLNISDIEALNSLNNQVMRLGAQVSSISKELSVVKSEVKNVGGPTTIIEPVKVPKKPNFLSIGTGVLIDPRMTSPTYGEKKSRLPKWLRDRASVWGEAPRPKPNPPLTALVPWDSVGDCWCSAPRNGVSQLALHLSRPIVPEEVVVEHIPKHATLNPGAAPKDMELWVQYTINKSTSGELPTDAGSAGWYKSYLNWLLSFESGVLETEYQSPMLSERFSLHDYIMSYLRPAYHNEPESAYWNATTLGPTFYRVGKWKYDIHGQHHVQEFSLDAIIDQPDIRVDRVAFRVNSNWGANFTCFYRLKLYGHL

SEQ ID NO: 42805 - protein, 222 aa, A.fumigatus
VFTVGGFLNVVSAAWINWFNAILFAALLVLELFLMPETLYPRTIMLQRMPRDGHKPPASSDIEQSPTDEKTGSMATAARPAIPRTRELGFFNVRPVPGMRHPKPWDSVVRFVLTFRFPVIVTSVIGYCFLWYWWILSVITMVPAAYASYTPLIQGLLFLGLFLGTVTSEICCSGRLSDYIVDRLAKRNGSVRVAEMRLWLAYPAILITAGELIVPLACTNGG

SEQ ID NO: 42806 - protein, 234 aa, A.fumigatus
LRFKKFLLCFSRLEDTITFHLIERVQFPLNKTIYIPGGVKIPGDEVSLMDYLLREQERLQSRVRRYESPDEYPFFPEVLEKPILQPLEYPKILHDNDVNVNEIIKKRYIENILPAVCAHLEREDRGEAKENYGSSATCDVNVLQALSRRIHFGKFVAEAKFQKDPELFVKLIKANDRAGIDAAITDAKVEQKVLERLGLKAKTYGTDPAFPSETGPKINVDAVVAMYKVRDKFD

SEQ ID NO: 42807 - protein, 86 aa, A.fumigatus
QSSVAAGIQMGNTVTSSYIIDSYPLQSTSIINFYAVFLNLSAFINPVRPFESLIVTAGSQLTDTSSSLLRNGRPPQDTHGRLPRRL

SEQ ID NO: 42808 - protein, 140 aa, A.fumigatus
YTAFADSVEDEDEVLTALSDELGSFVEYVGGSEFGHVLLSPLENLAAIEEPLVREKVKLIFESVVSLADRKLGRRVAQQDRGGIIREADRRILHPHGYSPLESRLVHIKSLCHWSLLRSLQEITTATAAKSPPIFRRPCT

SEQ ID NO: 42809 - protein, 65 aa, A.fumigatus
SIREGNLSLVLLWLSCSDCADVPRQIAKAVHEEVVTRDMVPSFVKLLKDTEAEVRTAIAGQIPGM

SEQ ID NO: 42810 - protein, 130 aa, A.fumigatus
LIVSVIGIDLLSQSLLPAIVQLAEDKQWRVRLAIIEYIPLLASQLGVKFFDEQLSDLCMGWLGDTVFSIREAATQNLRKLTEVFGVEWAQGSIIPKVMAMGQHPNYLYRMTTCFAISVSFPGPFRVMGHY

SEQ ID NO: 42811 - protein, 112 aa, A.fumigatus
TLAPVVSLDIIENSILPILDRLVTDEIPNIRFNVAKSYAVLIDTLRRLPAQGTLSELEKAGKPAIPSPRGQELIQQRILPSLEKLQQDEDVDVRYFATTAAGGHEEAMQTSP

SEQ ID NO: 42812 - protein, 64 aa, A.fumigatus
TKGGNGHCSLSEGYYKYWSLMSNVPKSKFCHATHSTACCKHIWVLQFYPHTMSWAPCTHGKVGL

SEQ ID NO: 42813 - protein, 66 aa, A.fumigatus
KTRYKLLNGLAVRRACYGVLRFIMESGAKGCEVVVSGKLRAARAKSMKFTVRQECFGESAQGKEGL

SEQ ID NO: 42814 - protein, 206 aa, A.fumigatus
AVESLNKIGEELSEKQIEEYFIPMVIRLSKADWFTSKVSATGLYCVPYRKSQPPLQQSLRQYFGGLVHDETPMVRRQAANNLAKFVKEMQTQVIIEEIIPLFQYLASDDQDSVRLLTVDILISIAEEIPKEQQPSHGVLLTSLRNLFEDKSWRVRYMVADRYEKVICPWCCSGYPVQIVLMFHDRSLRLYTKKLLLVTWCPHLLSF

SEQ ID NO: 42815 - protein, 70 aa, A.fumigatus
ASNWYTLFCSCISISLSTYTIDPWHTKLWSALEWSGMPPSEALQNLKVPNGECAGANSAFCGRTTYYVSR

SEQ ID NO: 42816 - protein, 158 aa, A.fumigatus
SSRYVKSALGNLLKGKRGYEGRCMMWFRNRGSASHDTGTVTDSVLSVQDGFMIHSGQPAKEFIDSATRHVLLRQGVLGIKVKIMRGSDPEGKAGPQKTLPDSVTIIEPKEEQPVLQPMSQDYGAKALAAQQLAEQQRLAEQQAAEGQEGAGAEAYAQE

SEQ ID NO: 42817 - protein, 89 aa, A.fumigatus
LCLISHTKSRYIKGFLLANMPQRKPISTSQKAALRAQKCLHPNVTQKDLRKWFQETYDHTLSSGLISDILSRKYDYLDADSEEELEILP

SEQ ID NO: 42818 - protein, 64 aa, A.fumigatus
WTDSRASCPVERPRRSLNDDAPDNVGAYDGGDPGFIYNTTAFSDICNTPSLKKTYGFFDRPNGF

SEQ ID NO: 42819 - protein, 65 aa, A.fumigatus
KSLGFGRIGSSPIADVSFFRLLFPQFYSISYNISSTSKPYAKNVSVQVSNTGYCWFHNGGTKTTS

SEQ ID NO: 42820 - protein, 87 aa, A.fumigatus
RSKSPPTGTHIFRQTLETPIVYTEPLYSYDLLCFEGIQLMLNIFLGRKPLPNYRLVEPANGQLEKIIVKEDVSRRGWKFYVASIWTK

SEQ ID NO: 42821 - protein, 499 aa, A.fumigatus
TMKVRPLVSGAILRNIKFDKARYESFIALQDKLHQNLARQRTLVSIGTHDLDTIQGPFTYEALPPKDIKFVPLNQTKELNGEELMSFYEVWTDHLWLIAINTYIYKQKDKHLGKYLHIIRDSPVYPVIYDSKRTVCSLPPIINGDHSKITLDTKNVLIEITALDKTKLDIVTKIMVTMFSQYTSKPFTYVRSASPCTHDTNSFLCSVEPVQIVSEHNNETRVEPDIAPRTTQAEVSYINQCCGLELSPEEICKLLTKMAYQARPSASSPDLIDVDVPPTRADVLHQADIMEDVAIAYGFNSLPRSFPSKSGTIAQPLPINKLSDIVRMEAAMAGWTEVLPLILCSHDENFAWLNRKDDGTTAVKLANPKTVEFQVVRTSLLPGLLKTIRENKHHAVPIKIFECSDVAFKDLTLERKSRNERHFAAAWYGRTSGFEVVHGLLDRIMAMLKSAFITGEECFENPAVNDLHYWIEELDGKFYMLFFFFFFFFFFFGYVYIRY

SEQ ID NO: 42822 - protein, 146 aa, A.fumigatus
PWNVKAAMRDTLLQPGTGGRAASKLCTACSTASWPCSRAPSSQVRSVSRTQPSTTCITGLKSSTVSFICFFFFFFFFFFFLATCISGTNSVLEPTYFPGHAASIHLRIAGKDHVIGAFGILHPTVLEKYELKYPVSTLEINIEAFL

SEQ ID NO: 42823 - protein, 81 aa, A.fumigatus
KTTCLMIGESPSRNTRTNSRNKNDFPIPQSHFISSITFGILPRSFTRNLGESCKPREILRQLQTLLSEREATEVHVVFFIA

SEQ ID NO: 42824 - protein, 288 aa, A.fumigatus
MRTEAPKSSCTGNPLSQCARSQAHGTRLEKSRAQRIMWLMEELNLSYDIKTYKRGPNGIAPPELKQIHPLGKSPIVSVQPPDASPMVLVESAAIIEYFLDHFSSPSTHLVPQRYKPGREGQVDGETDAWMRYRFFMHYAEGSLMSPIQVQLIMNGISAVLIPVMPLANAGTIAVRDAPVPFFIKPITGFITGKVSAEFLDQELRTHFRFLEDQLASAPENGPFLCGSRLTAADIQMSIPVIAALNLSIIPREEYPRLDAYAGAIQNEQGYRRAVEKVERIEGKPFVPI

SEQ ID NO: 42825 - protein, 226 aa, A.fumigatus
FHFAIANMKLTSIAVALFLSLSATAMPVADAEGDNAATPLPIADVEADTAAAIPVANVEADTPTTETPVAEIEVDNADIEEDTPDVEGDAPAALEARRVKCRFKKIGWKNVRCFYQGGDWSQYAFFLLERRPLSNANLWSIARGLRSVRILPSMPRILSSLRAISRTSLLAKVWIPIQSGVWLFTNCTRALYSTCPELCIVPGLTGRKSSGMVRDHRAIRSSFFSM

SEQ ID NO: 42826 - protein, 340 aa, A.fumigatus
CSPTVSFSMSNTKSSTRHTMYSLHEHKHLCRRAMTFSASGLDTLLHRPARESISSRLLRAPVPVLAELLYTRFVQTRTPTPTDHDGPTIRVVCISDTHNTQPQLPEGDLLIHAGDLTQSGTHAELEAQIGWLDRQPHRFKVAIAGNHELCLDPKTPAEAPGGNDPVDWKSIRYLENSSTILDFGYRRVKVFGTPYTPQHGNRAFQYPRNENIWDKIWIPEDTDILVTHGSPKTHLDLGRYGCKFLRDRSWSAKQKPWLHVFGHVHGAYGKETLCWDEFQRAYESIMDNEAKWPSMIRLLWHAFLRLIRLSDTCERTVMVNAAAIGGLRDEKRRDAICVDI

SEQ ID NO: 42827 - protein, 71 aa, A.fumigatus
DNTDRIGWIVEYLVDVRDRDLKDMGYVPAGFYGGGFLGRLLLAEPTYRWGERRMIFLYVVLCVGLQLMFWL

SEQ ID NO: 42828 - protein, 72 aa, A.fumigatus
PPNKRHSVIVIRIYLFVQSPFLSLLSDVELGGYPDLVNASLSPSIVSKLREYIYSINIRSLLDKPIQAVSYT

SEQ ID NO: 42829 - protein, 197 aa, A.fumigatus
SPKVTMRLPLLSFFILPLYALPTPSHSPKPPFFLLAGDSTTAKQSSNGGGWGDGFLNTTLFHGASGLNYGHNGATTVSFRAGGDWETVLSKVAEYKDRYAPFVTIQFGHNDQKPAANISLAEYTRNLEQFVSEARNAGATPILVTPLSRRNYETSNVTGEPTIILSLADQRAATIAAAKNSACGVHRSERCEYAVSE

SEQ ID NO: 42830 - protein, 217 aa, A.fumigatus
CTFSCHPQIFIITVNRYGTTFCGWLVAALSNSHLCQYLDLGVLLALGAVLQVLAHALRTWLPPFPLFAVTFFFASLGQAYQDTHANTFVASVKAAHRWLGFIHAMYMAGCLVGPFVSTAVASAGMHSRWNLFYAAPLGLGVINLVLVIGAFHDWLKVNAAVWSISSGVKAKGSAGDEADSLHAKCVVVESVFLLLPGRRYYRRWYVMLPASEIILTE

SEQ ID NO: 42831 - protein, 93 aa, A.fumigatus
SFLCAVVSLFGIFKLTVPSTGAWLFVNFIFDLLIVFLLLANIALSCSEVASWGQCVDYSRKFPAPGFEGRCNRFANAIKALILVGLVFEMALM

SEQ ID NO: 42832 - protein, 60 aa, A.fumigatus
SESALSGCQYSLSGLCSVFSKLVIYAMMIRGRHWGLLYQLDRAIVLPNERLDDSLGELMM

SEQ ID NO: 42833 - protein, 129 aa, A.fumigatus
EPLRGKTHEVRPYVEILRCVGPPRLYDQLFFHRTARKDDIAKPQSDFVLGYVAANSSKLLGYRAPNGRSVLHYIAAAGNEALLAVSQKEGADISVRCDKGEAALHVALETGQDATAVQLLEALFTLRAW

SEQ ID NO: 42834 - protein, 107 aa, A.fumigatus
RNFNGVLSCSPYDKQTSPASSKYLVSVGLLTRVDQGLRSNDYAKSVTSLMHSTDTALDDYVYLVVAPRSAQKASPQSSPPSPQPAYSPAHSESPPHKHPTADTPPAG

SEQ ID NO: 42835 - protein, 106 aa, A.fumigatus
TRSHLDRFFSQLSSLPFQRTHALRFDMDETTPLLPGQNDHNDEDTTATRLTRVSRIIAILIWSSIITSAVTFLYSLTVYLVVKLSLYYVFFSWGMRDTIEMLLPLV

SEQ ID NO: 42836 - protein, 81 aa, A.fumigatus
LVQDLQVGVLNVRLFQGMLSGGGFGAADLEILNRGGRVQVLNDTAQCLNCSRRLDISKSVPNNLRGWSASRGGQAGQEIHE

SEQ ID NO: 42837 - protein, 132 aa, A.fumigatus
RTPLGSLANLLENGNLLYRAGNGIHNLASDPRTVKTSGDESDVLELTVGFRLCENINEYSGGAKDENGRLGIRGTSVFNRAVGASSALGQNPPDLGGPLEDVGSADRTDRSCSINGCGCRAGGMAVRAAISP

SEQ ID NO: 42838 - protein, 273 aa, A.fumigatus
NAVQKDNDRFICRHDEHISERDIYHQGEIARARVLLSNKEINRNFLSSFTLHPPQQPLNEVSNCSKALRRVIDRPTYPFVEIGAIRGLVNDASPDTPVSESLRSLTISVALKCVPLEQTLHDLEDLILLDRLAVQLVKTLSVVTTAKVHVVSTVGLTDKGNLGEPGPGTTVRATGHTHDNAVACQANLFKGRLQLRDQHRKVALRLGHRQTTCRERDTSRGRQTQTAEGSVVELVLGHYLLDSGQVLVFDVGEDQMLVTSQAELALVELGQFP

SEQ ID NO: 42839 - protein, 387 aa, A.fumigatus
ARTHGELSCVLNTTVLDEKGEVVQALLILLPAKGVDVGSKLERAGFSKSQTIGKEGLHLALEGLNSHVVNGILETSVLTVLAVTKVPLDEHNLLTDNVSLISWHVTKHTTGLRVSLLVVVSCTHTTTSEDIEALKVSVSALDGDQTNIMRIDISIVVRRNGDGDLKLSRKVRGTVQRLVVLNRISCHLDLVVVIILQPNLMIGGSGRKQVVANLLSNCMGFAVKVGKLGQRTAHDVTVDITASSNSCHERLVDSTHGGTKVTLDDTVELEGLSCGELHSLVSVCAADLVHLNPLQGSSNTTRKPTTDHETVGWLKTLSLPLIANITIILHVGAVELGQLLVTSGNGTCGLIQQALSNGTAQVVGLDLDVLIGQGRGLLWKTFYLVDA

SEQ ID NO: 42840 - protein, 314 aa, A.fumigatus
TFLYVMSLETGASLITLSLLLNKISGLYGLLALLTGYHLSPVQLSMYLYSLIALGLTAYLFPHIRKQSPLQCLALAWLYLLDTVINAAYTAAFGVTWFLVISQHYDNGTAKGPGSDTISQTAGFTNPKYSSSSTNANSARSPDGLTNAVTQPESFQSIVFICLLWIIRIYFVFVMLAFARQKLRLYVAIPRHTQLPTHSRNTSIASVASVADIDREPFSPYSPDGQGWQGRLGRLMIGLGRSYWLGEDEDGAWLDSLGRKFRARGQELPGPLERERRRRSGTGPPQPSQATVQAAALQQPIPENLKMHDWTDGR

SEQ ID NO: 42841 - protein, 90 aa, A.fumigatus
SHSPVHAIVMFQLEHSPCDQSLIFQTAARVAYLVSDTILSVQPSLQTDSLFSKPLKALKASNARSILPRSAPEVSELATYPIAKISQNLD

SEQ ID NO: 42842 - protein, 517 aa, A.fumigatus
HCRQVVAVRSNEDPLLSAFHPLQAGDAVSVVTGSSVLLSSVPRLYRLANSPIVIHVALEPSPFPDFSVISSIRQCGFTFLHSETIQEAQDIAITAHALAHRSGKGVIHFFDPANSANEDAIEAENVDVIKSLLNLGRSTESQSGAQTLYADSGRVATVSDEIAESSAAQGGIASTLAPPAQTPSSVSVDNSSVGSSRRDSSTDSHATSSAATTVDAATSVRPVSAADIFEWTAQIWRILSQSTGRTYRAIEYTGPSDAKSAIFIFGSTGVFVDVLAKAEANSELENIGLITARLYRPWVGGQIVNSIPSSVEKIAVLEQVRKTTKWGPSFMDLLSSLTPPAGRPTPQIVGYRLGYVEPSTAVQALRGIVQNLNSSSPIQNLEIGSAKAPATEHSLEQPHVENAYLKILNQLFAERLYIANQLGSQNAGISSTIAASPEYGFGSLIARKERRQRFVREVEEASKSTDFTSDSRSSLSNWALNVKDASKANKLASEVIETLSKDEFQLVRGSLSRRSSS

SEQ ID NO: 42843 - protein, 140 aa, A.fumigatus
HGSSLSHSTTITGPQRDRAATQSPKPPASPTPNTAPRPPMQTPHEARMASRMPSPSPRVSKALCSSACCGLSAFTSCSSCSPLPARNYVSTSQSHATHSSPRTAAIPPSLALLVLLISTGSRSRHIALMAKAGRAGLAVL

SEQ ID NO: 42844 - protein, 148 aa, A.fumigatus
PPCLTRLRRAPLPKVALLPPLRRQPRLLQASVLITHPSDRHGEIAARTAMPPALQPQPLMLQLRSVRSALPTSSSGPPRSGGFCPRALDAPTARLNTLVPRMPSRPFSSLAPPEYSLMFSQRRKPTVSSRTSDSSPLVFTVLGSEARL

SEQ ID NO: 42845 - protein, 960 aa, A.fumigatus
VEEALLEESQWLIGSDAWAYDLGNSGVHHVLASGENVNMLIIDSQPYSERAAADPTRRKKDIGLYAMNFGNAYVASVAVYGSYTQVLQAMAEAEQFKGPSVVVAYLPYNQENDSALTVLQETKKAIDLGYWPLYRWNPENETKGEPKFALDSDRLRRELEEFLRRDNQLTQLMNRKPKFSAVLSESYGTEVRALQKRKAKDSYEQLLEGLFGAPLTILFASDGGNAQTLAKRLGNRGRARGLKTMVIAMDDYPAEDLATEENVVFITSTAGQGEFPQNGRSLWEVIKNSGDLDLSTIKYSVFGLGDSHYWPRKEDKIYYNKPAKDLDARIAFLGGRKLTDIGLGDDQDPDAYQTGYSEWEPRLWQALGVDKVEGLPEEPAPLTNEDIKIQSNYLRGTIAEGLLDETTGAISASDQQLTKFHGTYMQDDRDVRDERKAQGLEPAYSFMIRCRLPGGVATPLQWIQMDEISSAYGNETMKLTTRQTFQFHGVIKRNLRSAMRAINKALMTTIAACGDVNRNVMCSSLPELSYFHRETHAVAKKISDHLLPATTAYHEIWLKDDDDNKVQVAGDAVQDHEPLYGPTYLPRKFKITIAIPPHNDTDVYAHDIGLIAIKGADGHLEGFNVLAGGGMGTTHNNKKTYPQTGRMFGYVPADQAHIVCEKIMLVQRDFGDRKNRKHARLKYTIDDMGVETFKGKVEALLPDGLRFAEPRPFKFTSNVDTFGWQKDEKGLNHFTFFIENGRVEDTAEFTMRSGLRELAKLDKGEFRLTGNQHLVFTNIKDEDLPAVKEIMAKHKLDNTSFSGLRLSSSACVAFPTCGLAMAESERYLPVLISKLESTLEEVGLARDSIVMRMTGCPNGCARPWLAEVAFVGKAYGAYNMYLGGGYHGQRLNKLYRQSIKEDEILEIMKGLLKRYALERNTDGETPERFGDWCIRAGIINKTTDGTNFHEGVCWPINHSS

SEQ ID NO: 42846 - protein, 297 aa, A.fumigatus
RCSCIMLSRVARQKTAISLLRQSNGRRLQPSVAGLRFHGNASKPSLLASASVTTPQEQTHRPSFQSNRTLATAADQSAVDQGSYASFDDSHYAPENFYDPSQQWSKLFPSLPAKELDPSSLIIVGESLQTKPKVSRKVRGIGGDEDEMLANLDVSLKVGRFDRAATLINRLGQHYPVGSSEYLAIHNRYLEKMVSHMIVTRQHNMVLPMQRWFELDMPNGGVKADATTYAIMIRMALRMLHGSKRDRAVRRYWQFAKKDNIEEEVLAVPVLSELELGELSEVRSLHLITMLPFSFSY

SEQ ID NO: 42847 - protein, 310 aa, A.fumigatus
ICSSDLQRVAIGSIGSEPAPAVAVSSQTDNLAEVRPVEQKGLGLSSLKQSLSLFLSESSPSVPADPEQKLAFDELKQRQLEADSIRSAMNRWRQEFDNRQKLGLDATAGGKKLGAIMTEWHSSLVARIKEELELVAEAEANPIRTLEQKERCEYGVYLRCLDTDTLAALTILAVMSTFSRGGMEKGLKVSAVVSTIGKDLQDELIAEAALKNEAGTDSRRLKALKELLAGRKKKGGRAKWHALVQKMQKEDATIMWSPRETAKIGAVLMSLLFEVGKAPVTMEDPETKKKTVTMQPAFQHAYQITFVHWQ

SEQ ID NO: 42848 - protein, 178 aa, A.fumigatus
LGHPVVDPFENSSRQISPLMDDSDPVIASYDVYLTDSEISRFVLQYLDRSAEHPYDERHEQKPTAFRLKPNTGLVEVDVPIQTRVNYDVSKGLRYGDAMRRSRSARDGGSYGLAGGFSSGAAAGGGKVKMEGNVDVEMAGMDSKEGSDIMRVQTLGGRIKGPEDGDPVYMLAAFRGRG

SEQ ID NO: 42849 - protein, 75 aa, A.fumigatus
LAFKQTEEAWQTYESYMIQQDLENVPQLEAAIDSEDYLDRMSAPRIDPARPEMTGWAMKQNRKRQKEQASINAQG

SEQ ID NO: 42850 - protein, 71 aa, A.fumigatus
HTCYRSCELQHTRIITLPSNLSLSRGEGTLSYWIIGSIIYGIYFITGCQSSSQVHSGTNAYWKVEYAVPIH

SEQ ID NO: 42851 - protein, 71 aa, A.fumigatus
FTPCQRLCKTPTSIRYLHVIKMFITTCHYRKAKMQKKLHRRHFVSYYLSLFSEWKVRNAVILRELDVYALD

SEQ ID NO: 42852 - protein, 236 aa, A.fumigatus
YGNWTCGPDLELLPMIDIANIACGFHGGDPLIMMETVRNCKAHNVRIGAHPGLPDLQGFGRREMKLSPEELTAITIYQVGALQGFLDREGVPLHHVKPHGVLYGMMCRDYEVAKAVMLGIPKGVPVFGLAGTQMEKAANDLGIEFWAELYGDVKYDSNGMLVIDRKKKPWNLADVEKHVRQQIEEQSVTAVDGTVVQLPLKTYPVSICCHSDSPGCVDIIRTTRKVADEFNAKHGR

SEQ ID NO: 42853 - protein, 567 aa, A.fumigatus
IRPRLRSEIMTSRTSLLFSFPSVLQRTARPLNTEISPLRVPSIRGRWYGSDRGSSQPKERSIAAQDAEKSPDLSHLNPPPDDYSRFIFQDKCRSTIYAGSGGNGCVSFLREKYIEEGPPNGGDGGSGGSIYIQAVEGITSLHKLARRGVIKAGRGKNGQGKSKGGRRGEDVLLQVPVGTVVREVDRYDPVAEELKRRKTPAADVDELDEIGLPSVRHDRWVLYPGSNPSDFLTTVFPKNPPRRQNIAAMEPKAPIYLDLSKPMDKPILLAAGGVGGLGNAHWVSRSITRPKFASRGEGGMRLELEFELKLLADVGLVGKPNAGKSTLLRSLTNSRTRVGNWAFTTLSPSIGTVIIDDYKGRPLVEAKGKAMRTNFTIADIPGLIEGAHLDRGLGLGFLRHIERAGILAFVVDLSAGDPVQGLQNLWHELSEYERIRNTESVLKSEDEWQPIGGLPELASQNPVDHLDSTRDSPTNIPDGTKGQLPSLELPPIHTKPWFVVATKADLPETQDRFKTLRDYVAAVQNGVVDHPGGYPDGWKEKVCALPVSAIRGEGVSRIPKLVMELLD

SEQ ID NO: 42854 - protein, 582 aa, A.fumigatus
LHDSLILPCAKMTHLPSVVANALAALTNPAPEDSILECCDNDLAALRELLLKNTDRALELADAKLRVFPFKDVKTCWRRLYTDASIAKVCLAICRNCGFSCDGIPADNNPRIADGTEHASTLDPTPRQAEYKLDPDAPWLLSSIHALDNALIMTGAPLRENLVESLFSALHLSTQAYREGKTDPRSTHDYASDSELGGQAFKRRKLSPPLFPPDAVPATTLKHPVPRVSAPSFDAIEHHIQHVRTPLVITDAVDHWPALSTRPWASRDYWFDRTLGGRRLVPVEVGTSYTDEGWGQRIMEFRDFVDKFLWRGEGKTSKTGTGKEREDDGNDTGQTGYMAQHDLLSQIPALRKDICIPDYCFIEPPGPEPETPVYLKKQREREEKLKSSNASSGVGESHTKSHEQQQHENAASDDESSVLGVPSDPIINTWIGPAWTISPLHHDPYHNILVQVVGAKYIRLYSPHTPASRIYPKGMEAVNSLSGSNASAGLSDSAQLQGKGSEARVEKQTQLIDMSNTSQVDLAAIELSPAESEQWEEMWPGFLEAEYVETVLKDGECLYIPVGWWHYVRGVKAGISVSFWWE

SEQ ID NO: 42855 - protein, 277 aa, A.fumigatus
WVVQVMLKATAGGGGMGLLTCNSDAEVRKSFATVKSRGEALFKNAGVFIERYYPASHHIEVQVFGNGDGKAIFIGERECSIQRRHQKVIEECPSPFVSRKPGLRKSLGEAAVRLAESIKYGSAGTIEYLVDDETGAFFFLEMNTRLQVEHGITELCYGLDLVELMLNQADAQLSGKNGVEASFLEALPVETPSGAAIEARVYAENPTKDFAPCPGTLQTVEWKEIPGSRIDTWVYRGIKVSANYGMSHEQNPLFGTLAGLTVTCRSPTREGHVPLAR

SEQ ID NO: 42856 - protein, 100 aa, A.fumigatus
PRSPSPSPEKSTLTCSFLDTDPEIIPIEAPLNANVWKVEVKQGDKLDENQVVVILEAMKLEIAVRVEPSTAGATVEKILAPPGEPIEAGKPLLLVRKIKS

SEQ ID NO: 42857 - protein, 449 aa, A.fumigatus
HVDPLLAKVMYHSPDRQQTILGMREILKQSRICGPPTNLDFLVKILEEEAFVVGNTLTRFLDNFQYTPSAIDVISGGAYTLIEDWPGRPTIGRGFCHSGPMDPLAFRIANALVNNPVGLEALEITLSGPDLRFLRPAIISLCGAPIEAKLDGEPVPMWSRVKVAAGQRLTIGKTTGNGCRAYLAVFGGFLNVPKWFGSKSTSPGVGVGGYQGRQISSGDLLTITSEIPEVNGDLRIPEHLIPDYPNHWELLAMPGPYDEGYLTPESIEMLYETQWKISHNAARGGIRLLGPKPRWARSDGGEGGAHPSNLIEYGYAIGSINWTGDDPVIFPQDAPDFGGFVSSHTIVKADLWKLGQVKAGDTLKFRAVSLADALEARRDLERFVDELVHCCKQGHGFHSVKVLRGMPPEQTAKTRGKGVVHRIEEQGNQPLVSYRQVWCTCRWVVWATS

SEQ ID NO: 42858 - protein, 160 aa, A.fumigatus
ELVPADENFITDSLFAALMLYYDGMKVSQQRLISYLCNLETQLGDLSQAKMPSRLFRLPLTFESQRQKDAIQRYMETQRPYASYLPDNMEFVAKNNAFTKEEFENIFLTASLMVVSVGFFTALPLALPVDPRQRMNCPKMNPSRVYTPAGSVSWGGSCMA

SEQ ID NO: 42859 - protein, 155 aa, A.fumigatus
PHSNRLYNVDSPGGYQLTGMTIPGVDILGSKKGYSADRPWLFEEFDQITFYQVSEEEYEKQLALFNSGKYEYQWEEVVFDMAEHNRLLQETRDEVAAIRARQRQAQTEMDKIEAELLERWAKEKSERGVSQDTIESLLQGKPSQGPPPPPPRSRH

SEQ ID NO: 42860 - protein, 61 aa, A.fumigatus
QVTISPELVVFFVLMVFNMEKHAIYMLKQPSSPVFGIEFIRYLSRRPDDVNASGRVRVAAY

SEQ ID NO: 42861 - protein, 161 aa, A.fumigatus
SDPGASSDQIIQIAKQNNANAIIPGYGFLSENADFARAVAAAGLVFVGPSPESIEVFGLKHTARELATKAGVPIVPGSPGLINNEHDAVEVAQKLGYPVCIVKQERILLAGLMGGAGHAESYRWWWWDGFAYMQFRRRSAQVLCNCQVARGSIIQECRRVY

SEQ ID NO: 42862 - protein, 134 aa, A.fumigatus
SSIITVPILGESVVNAQFPTRVRLLVNDRRSVLLPAFGLPTNPTSASSFNSNSSSSRIPPSPLDANFGRVIERDTQWALPRPPTPPAASKIGLSIGFERSRYMGALGSIAAIFCLRGGFFGKTVVRKSEGLEPG

SEQ ID NO: 42863 - protein, 375 aa, A.fumigatus
IVPLPVRAPRFIIPIPSQTHSARMVENLRPRNDPFRGSKDGQDNKTNESSSSEESGSSSDDDEDEHQRQLQSQSQSQSHLSGSVVSGRRSSNFGLDDHVAMSVSPGGDSQRAGSMGSGSGRTSFRKRGGNSDVEEDSGAASDRQEDGSGGAGGPYRPPWESLLGLPADVWEKLLSPSPAWHKRRFEVGINDLAFIGWPVFVREDGTWRKQRRKKKKKRRADWEGGELGHNENAEDAPDDEDGDAGGNASGGGGLMAASTETLSPKQVTLSEAKRGSGSSGKAARSLVDCLDGDDKDSMTMFNVVFVLDPPLLEYSMRTKEVYDNIIKKFAKALKWEQARTDYVWREAQHISHLKEKAKERSKSQCSRTFSETSEC

SEQ ID NO: 42864 - protein, 70 aa, A.fumigatus
AFPQNLALIMFKVILAVSYIRLRSVLGPCLYHVIQMSSQHRRVTSTWLLVWNKQAIFTDVGSGSWMYLKY

SEQ ID NO: 42865 - protein, 241 aa, A.fumigatus
TRVCRRSQRPRVPTAPTAETSQEAEKAAASTDKDSESTATASSKTNVSGTSSPSVGASSTSTVSKEEEGSNTPNGTTESNWDKQSQVSGTDKQGNAQEAKDKPNASSDKDKKPPLKELKAAPLPAVNVWQQRKEAQEAKAKATAALKSAASSKPSASKTASVASSTSGDNHQELPKTAPKKKGADATSDGPKDRKRADGGKGRDESKSKSGHLWFFTTNVIAMDSELLERPGARFSPQSAS

SEQ ID NO: 42866 - protein, 515 aa, A.fumigatus
NGNRPERITFGGRPNIYHISKKKLKRGVSRNVQEHSLRRPNADASYVGTSLNTLYTELITQSSLARAIYTVHTSISASKIASVPLSPDVSISLQIPPLTSTPYLPGPTDKAYPGLWLTTADSVTPVEDPTADEYTAPHQVLAKHFALLLLDNEAAILRDVEASGGALAPALAHYLRCSKPTKSFAQISASSGIPLSTIQMLASHLVYWRRARAIPPIHQRDTYIVSPNCDLSKLEVATAAYQAAFPTLPSLPKMLSALSGTPRPYGSFIPSKDHKETYFAILAWLLRGGWVTQLRSFARVKVTPEIKMAVEVALRREEVDKYLRKGRSLEAQKSTDGENGNEEDENDDASSSSSSSLASQGSGEETPMPGRYQQESNPRLSHSMLDRNTSLRTSSLILFPHRASPLESRWLEQIVSRFPEHPRSAGRHRRGEGSNAGGGEIDPEYAALSTPMKDLWPTYIKYFNGLDALEKIPVREGLKRKFVWQVLTRLGLVTSQQSSIELDPREQVLVSVRHW

SEQ ID NO: 42867 - protein, 92 aa, A.fumigatus
IPRQRSFRVLVIKTAFAIFIILNRTSFSYYRNETALDDYRWSSRDKFFLPRITFYIVAGYGVSHGDLFTGQRLQATVEVGLIPVPGSCSSTG

SEQ ID NO: 42868 - protein, 400 aa, A.fumigatus
SLWTLNYWRDLEPALVHNRQANRDSADVSIPPVGDASSWPTPQVAQGEEKRKAQEKTEKTEKSPVIRPHGKEKWMPVPYVPTAVFNTPLPSSARRGGRAGRVGRDGARNATHGAPGADKAATGQAAQGSTAKQNGVGDRGRNEPSSARANSLPAPSKRSNSVDAGLADSRKGTQVADRNRAPKGAENMNGLPAGRQAGGNENLPPRHRGDAKPFVRNHDAAHKGGDSTSKSSHPLADANTGLRSSSTHDRRFENGPKSADLAGFPGDRKEKDFSRESRADRGRGSHRGRGGHSGFTGSQNSQFPNNHMGHHSFVHPKSFGFNERQRSHHGLPNGSQQGHRMSLRSPSLPNSASMYGVYPFPADINTMYGYQPIPAGPMTAVPYQPYMEPFSLMSMISMQL

SEQ ID NO: 42869 - protein, 188 aa, A.fumigatus
VMSFVFIVLLLRFATEIDPGREYYFSVDNLCKDLFLRKQMDSQGFVPLSVIAGFKRVKTLTEDFEMLRHACRQVRNIEYLTGEDGIDRLRPRDKWEQWVLPVEQRDPSAQNEGPSLSADAGKFDEQNQAKETTNGLPNGSTEPQVLKTSLSSTAPEFSPSNPVIPQAEIANVGSHLMTVPSQMLKLRS

SEQ ID NO: 42870 - protein, 144 aa, A.fumigatus
LVSDTAHDSLHKDHSSVLWDGKQAIQPSLLLPSDNSVPESYSTFQKRVLYEQKLTPDQDDDREMDILYQFWSHFLVSNFNAQMYNEFKSLALDDLSFQNASNGFNRIGRFMVPFCRTKNISLLRWSKTSLFYEGGNCLPTRVGI

SEQ ID NO: 42871 - protein, 85 aa, A.fumigatus
QIGFCLYSRSQSSALPHPSAIGSIIATFSFSLFPSYFPSLSLYRCLLTPLLPSLPLTYWDVLRSSFYSSLHSHFVYRRPLGVCVA

SEQ ID NO: 42872 - protein, 851 aa, A.fumigatus
RHLTPLQETRRTLDQAQKQYDSLLSRYASQSKSKEPSSLREDAFQLHEARKAYLKASMDFSVQAPQIRNSLDRLLVRVSFDQWREFKTLHNDNGASFAKWGQEMDRIKGWIHEMEGSEKFSKRELLSARKHIEDAAELAARPSRELEDYSVSTVPYLGSRPLSDLNMTKEARPEKQGWVYLRTLSGKPTRTVWLRRWAFLKNGIFGCLVLGSRTGGVEESERIGVLLCSIRPAFQEERRFCFEVKTKSNTIVLQAETQKELTEWIAAFEAAKRKALENPTSTDISVSGRVTIQDPAFAISQPPAPEFAADPADSLTPHANDEHGPSDRSGGLSVPEREPSAFRNSSDLGSPRRMTGLEPESSAREHTSRLIQKLDLHRKSNNNAVPPSISLPGAGGGIAGLISSSHSTLGHSNGLSVGGTDEGNRSRSLTSRSLPPTTLAPSTLANPPAPTSMSKVAVIVSNERGIGLGQADKTGGMPSGMMANLWGSSNWGFMNRLERERDAQLARAGELASVGQRTSTPVIDPSKQPQSSDADSTNGTSASRQQMSGPRHRQTVSLDGDASKVQRAILGISHEYPSYYPEQLRSQDAQFRLLFPDVKREEPLVMVFRATWNPNDQQEFPGRAYATTRNIYFYSHYFGLVLTTGVPLESIKEVTAAPGRDCDFLFLHTIPPLGEDTPGRITVKTFLEPLRLLQRRLNFLIQDSTSVEPMGLEAIFKALIRMETDTRNRSSSLNSWEDAAVSDDKNGIEEDKLAAGQQKDIRRPIYIDYDLDPHSKHGKHGKNAPKFRLPTQPVQYVPQGNLRLAAEKIFDISPKAIFHILFGDKSAVWQLLLHERRSRGSSLYPHPRMIG

SEQ ID NO: 42873 - protein, 373 aa, A.fumigatus
LHLSRRGKASLQYTRKWSGLGLLTAFRVSGPLAIARLLSCTITKLFPGIIEKQATSDLEQDALDLVDLVSDQVRKLGFHSRTKKAITIFGHIGRQQHTSQLSSSESVLKLEPRKPRRQRTLTQLLLETLLSFLESAVSSIIMWTFALLRWTWKTTNANMVILALLISSALMNGLFTSRYTYDWWHERNVGNFMARLGVGPNHVMSKAIYMRDIDEVIANATVGQSSNNMSKCFSTFYQQTVSDQGTVLSFGASGPRDSVTRSAARRIHQTRERLAMYRHNLLVALRVVNSIEREVIQGEWERWLRQELRRCHQVEKLLGKDKEDDGFNTQVDQASQTVFADLAGDVQQWYDKYCTSCQVEQEQLERSGIVYGN

SEQ ID NO: 42874 - protein, 153 aa, A.fumigatus
SLSWGVLQEAITTVNFPVRPPTAEEPNPPTERFTFSIVLNTIQSTFAAITGFLYLYFSTPAGKKVPSIFPTRKILFPLLLVSISSSLASPFGYASLAHIDYLTFILAKSCKLLPWMFFNWIFFGKTYPLYKYGVVLLSPLGSRNFHLPPPWNQ

SEQ ID NO: 42875 - protein, 257 aa, A.fumigatus
HLFWPSRASFCLGCFSIGYSSARHIRCISTGLSCCHPLGVATFTFHHPGTSKKVAASAAKNQSGSSLYGIFFLSINLFLDGLTNTTQDHVFSSPQIYTRFTGPQMMVAQNILSTILTTTYLLVMPHLSSTGALHALLPIPIPPSTETELASAVSFLSRHPEVMKNVLGFAACGAIGQLFIFYTLSRFSSLLLVTVTVTRKMLTMLLSVFWFGHTLSAGQWLGIGLVFGGIGAEAVVQKREKQSKEHIHHRGRRSAQG

SEQ ID NO: 42876 - protein, 566 aa, A.fumigatus
  UNSURE (166): Identity of amino acid sequences at the above locations are unknown.
HSLRSVTVESKLGKTSALGKRHDRDEDDSDDSEESSSDEEEDEDGELVTPAVDAEIMATLNAIRSKDPRVYDKNTKFYTALDEEEENANTGSTEKKQKPMTLRDYHRQNLLSGANLEEDDTSDTPKTYAQEQEELKNAIVKEMHPTADQNGEDKDEDGGFLIPKSXTKSASEPKEEIKLDVENADKDPETFLSNFLSSRAWIPAGRSELQPFESEDEEELERAEAFEEAYNFRFEDPSKLNATLVTHARDKTNQQSVRREEKSARKKQREAERKRKEEEKKQREAEKNRLRKLKMEELQEKVKKIKEVAGLQASKFTDEDWARFLDEAWDDDKWEEEMQKRFGEDYYAEEDASGTDGEGKRKKKRPKKPTWDDDIDIKDLVPDFDEEEPKPALEDSDVEMEDDAEDTNKKSKAQERRDQKREARKDRLRIEEAIDRNLDLDISLLPGATKKNTTRFRYRETSPQSFGLTARDILMADDAQLNQFAGLKKLASFRDPEKKRRDQKKLGKKARLRQWRKETFGNEEGPVFSFGSEKPVGNAEQADDGDKVDIREGEPRRKKRKRSKKH

SEQ ID NO: 42877 - protein, 221 aa, A.fumigatus
QLTMPTVLTSTPQAPEPSALTTLLTSTSSSSNPLSATAIQVLHNLQHQHLWTSLQIHDLQISNSSVSPSSTSTSTDKLSSSPSYLISGIPPHRIYTHPDEQLFMLERGLREDDIELERMFVIPTAHGQSWSLRKMAAVFDALPEDEDESNAQSLDDAKASGNNAEKAAKLTEYYEYRRKARVTKEWGGKRLLLAMVDRSMGGDGTMVYYVVQEGAVKPRQN

SEQ ID NO: 42878 - protein, 122 aa, A.fumigatus
KALHKSAESAALGIFVSSSLIFAFLNWTKMEPPAKKPRKLLDDDSSSDSGDESGGVPITDQSEPAFKINEEYARRFEHNKKREELQKCKSALLRSTTVSVTQSEICYSGVKIRKDFSARETP

SEQ ID NO: 42879 - protein, 60 aa, A.fumigatus
SPGLCGPHPLKVNRSCSQSQTPLGLQWSIQEQYLNLHLILPPLARFVYDFCGRCLIALLQ

SEQ ID NO: 42880 - protein, 82 aa, A.fumigatus
SSQSSYLLLCAPVRADFILFVYGVSTEWLDDKYLRRYMILLLDPAPAPPPIIVIQNPPLLLYFTRRSGPSNLRFFRSIFLHL

SEQ ID NO: 42881 - protein, 198 aa, A.fumigatus
LQTITSLQSICTKDRLVIGIHQSHCPTMLARQEDADLSDRPSTRASNDLPDYAAHIRSRSTVHAHSPKRLSVFSGRSRSNTSTSTSSSRRSPASSMTSADAASLPYSSEDRASSSAGTRSDRHERHESMTKSLFTRGSRILRRQGSKFNIAATLDEEDEVEREKSRFEVSEIFSRHHKTRQSNARKSNAPAQSNIRWR

SEQ ID NO: 42882 - protein, 489 aa, A.fumigatus
STTVVNRLFFLTFRPRSPPSKSFNMASTPSQTLTKRQSEQSLMPPPPPPKRIRRPATVLDEDVYTNALSEIIARDYFPGLLEERVKQEYLDALESKDKAWITSSKKKLTDLLKTPGRARTVPRLHGTERPYDTPTGWQGDTPRSVISTTTAAMSESAPKDIPDVSNLGLMAFQAKYTSEDNESFNKLLDKQNAKRQEKYAWLWSGNKIPTARQIAHRQREAKRIAAQGGSIERQLAIKTDLDARPAKPDTWKSRPENSLMFMPSSIEDTHETISQKAEALSRAGPKRVVHENTRLPEPSVQQEGNNVPPSPSISAIKDAIAGRPRLTESEAGYAGGETPRVNGYAFVDEDEPEPDYGHAAAESSELTSLSGDDLRLLGASDSAPNPFSIRENCKREELHHRMVDRVARTKRAEKAAREITTPVTPRFASSPRLDFGLRTPAAAASSGQGKALTPAAQKLLQRVGSTPRPAASSSSSLRNMWTPTPRKAK

SEQ ID NO: 42883 - protein, 662 aa, A.fumigatus
HGYTDEHLKSLISNPFDFHHLTHTSPSQFQALDKARENDIVTEFSAIRASQRPMTGLKGIRADDLHFRGFSSEDLTDGGAATAEHQTSPTLTSPPVSPGVSSSVSPKQHDHRARRESRVFENFSRPVPRYPRAGSTTPPPRTISPQLTASPDLSEPAPRAIDEILGLSSQPTYPEHVYGNTDDVEQYSSMPQFRVEGIFSFQPEHAVTTDASTERIDAESSVSLPSLKSVLKEVPEEEGITSWHDSPEANADTASSPSSSQIDPSAKVPISSVQHRKSRLSICVAEELSRKFSAALGSPTLPQYRLFQDAADQAVGGPIRRRSSAHRKPAYETIYESWDADIDYCYEHAAESTFDFDWSGNSLDEARPADNDDDSRAACGGPANESKDVELLRPTQLNMPRLPSPELDPSQARSSLSSQVAVTPSSAEYESEIVSTGGDYFQPVNSSIFPSAIGKQMTHDTLYEEYLAADAESDRHFSFCSQGVIHAMDHPVSPRSSFSPISKCNSQESLILSRAASIVRKHRSSVSTASVPELVHSLASSRELPSMEHLPSMEQSSHTAPSLAGRTEVPCYHRQTRSLAREIETQIMSRSENNPSPGPADPARASGMVHDRAKSTSEVDVPRTVRTTRRNASAPLPPVPLKSPNRRKGRTSYSLFPTPAAN

SEQ ID NO: 42884 - protein, 446 aa, A.fumigatus
GGYRPSEPSWLMQLSMRTDFSSMHYLSVAYFGALILLYGPIFLVKPCLALDPPSDSALLIFSNDTNVILHDVTGQFTSLHGSYSGLDVQDTGSENGETRGLDLVRRVPPGVSSLGNNQFKTSGIKLGETQWWYFPKESVNGKKSNVTSGLPERISVDRTSQQTVRSDELRKRDGDTVKRSTSVYLSLTMCSKPDINITNGTIPDSVPSLPELNLYVSTSESLQKPGPGQDSSKQEVFTADEGYVGASVQADGDVFIGVAVQNSTAYSGGYTYEIAASIDAYFHSVVDEPFLHFVDADIHAALLTTDNLTLSEEGSENYQQWMNLTPPFTMFAHNVNDTAISGLQRSYCALEQLAQLREGDHGVEGGMTNRGLGKKPKEQFYITGLNRTSNYSGILAMDGNSTNSGNGIVGGGGTVWKPMYFATKSGEQVTSLCSSLKRSKVLTWNR

SEQ ID NO: 42885 - protein, 231 aa, A.fumigatus
PGTDDNCAVLFNLTFCSEVAYAVPSNPEFGIAQLGAKYDKYAEALYRNFSYSLDQIQCNTTNETSFSLAVSCNDCADAYKQWLCAVTIPRCADFSSNSVFLQVRNAGQQFINGSSLSPTDPRRRDPAQNKSRNSMIDDQIRPGPYKEILPCQDICYSLVKRCPAALGFSCPQGARLSSAYGQRGSSSEITCSYPGAAYDLNAGRARREPLGWLLLAMGSFWFSFWALRVDA

SEQ ID NO: 42886 - protein, 103 aa, A.fumigatus
SNDNRMLIVSDRMVSLFVRLPAFPSFLLPEFLSAFLSKNSGRLSGSESWRLIRPPKWRQADDDVTLFRLMVYQLQLFLFDTFKRQQLFCTEQSEGLNSIVDNI

SEQ ID NO: 42887 - protein, 66 aa, A.fumigatus
KTITPRRQTNHGTKEEAASVSTEWDACIKGPKAGLSPTPYTSRRLEMYVKSQSSLQGYDTVNQVPI

SEQ ID NO: 42888 - protein, 61 aa, A.fumigatus; identical to SEQ ID NO: 32766

SEQ ID NO: 42889 - protein, 127 aa, A.fumigatus
PWQVVWLSSMFYLACLGFIKTSVCWFYTRIGDKTLTRMSLIMMGIVGTQATVFVMVAAFQCRPIPKAWNTSLPGQCVEINIFYLANAALNILTDLLTYSLPIKVLLRLQMPVKQKLALGFILCLGLL

SEQ ID NO: 42890 - protein, 162 aa, A.fumigatus
VTRSPRRIGTLTRLPSACISSIIRISYIPTMLKSADFTYAISGAMYWSVIETNVGILAASIPSFKAIASRFLPRLIGEYSSGRKYGSSTLTGSKPIHWGFSRFKDSVTMNSLRTKDAEVMPTEIGKGYGSNTSEERIVVPNGKIWTTTQIETNVEITNTSIR

SEQ ID NO: 42891 - protein, 82 aa, A.fumigatus
FSVAFSASFLSTPPWPISRIIYSVRTFSLGVIPYMAIIIRTVYSILHIIRTSEDETDHQFAGTVSLNSGNGQKNRSQSLSVR

SEQ ID NO: 42892 - protein, 208 aa, A.fumigatus
RCARIQVSATAAESPCPLSASTSDQGKRNHHHTEQMSTASIGVIVGSQRVPRSGLQITQFVLKTIQKAYPTANLRLIDLATWNLPLYNEPGIPSFLNSPEEYTHELTRKWSEEIASHAAFIFVTPQYNWGYPASIKNAIDYLYHEWKGKPGMIVSYGGRGGGKAAQQLHQVLQGLGMQPVEPSCRFDVSYAGVYGESDQGRGSGSAGG

SEQ ID NO: 42893 - protein, 105 aa, A.fumigatus
VVQRRHQPALISPRIRHVKCDEQQPECLQCVKTGRKCDGYDPQQTNPQAQQRAVLDPAPVAWTKPSTDHRLVLRPGTRGERQYIEFFCTRTSRALSGFFDSDLWQ

SEQ ID NO: 42894 - protein, 583 aa, A.fumigatus
ASGSRNRADHQTRFDFYFKSCSAQPATMPPKARINSKNSVEQEGRVLLAVSALKNKEILNIREAARVYNVPYTTLQRRLKGHTFRAELRANGHKMTQNEEDSLIRWILSMDQRGAAPRPSHVREMANILLAQRGSTPTQTVGEKWVYNFINRHDEIKTRFSRRYNHQRAKCEDPKIILEWFNRVQITIMQHGITLEDIYNFDETGFAMGLVATAKVVTRAEMLSRPFLIQPGNREWVTSIECINSTGWVLPPCIIFKGKVHIEGWYQDTALPADWRIEVSENGWTTDQIGLRWLQKVFIPATTSRTTGRYRLLILDGHGSHLTPQFDQICTENDIIPICMPAHSSHLLQPLDVGCFSPLKRAYGRLIEDKMRLGFNHIDKFDFLEAYPQARTAIFSADNIKSGFSATGLIPLNPDRVLSQLNIQLRTPTPPGSRSTNSVPKTPYNLKQLKKQETTLKKLLRERTYSPPTPTKAVLGQIIKGCEMAMNNAALLAKENHDLRAAHEKHLQKQKRSRRQIETAVGLSIQEGQEIIQRRDQAAEAIPTIPPEQVVDTEQRPQRAPPRCSDCHILGHRRLQCPQRKNN

SEQ ID NO: 42895 - protein, 235 aa, A.fumigatus
ISQLSSSPHSSSSRKPPSSQISLVQCPHYNSQSHNQKMSSVQSFRQLIGVPPSTASAKDSSLIIIDAQNEYATGHLKTANVSQTRKAIAALLEKYRAGGDGKNIVHIVHEVPQGAPVFTPDTDLAKEFDELTPRGGEKVITKHFPSAFAQTDLDEYLTGLGDAGKKVVLVGYMAHVCVSTTARAASERGYDVVIASDAVGDRAIPGASAETLVSVVLSELADAFATVLPSSEITA

SEQ ID NO: 42896 - protein, 119 aa, A.fumigatus
PALDEPSPAQEQSNPTARWADTSTGISNSSTESSSSNGSNNAPTHSEPERSVPEQRSQTMPGGDSSSQQKEDGGVERAPPTTTQQVSAEALKGPQGPAPREAYEFEKEIDGQPSKTKTG

SEQ ID NO: 42897 - protein, 335 aa, A.fumigatus
PATYRKYDRPSYTLSTFIPRKSQTFYLALRALNVTLSMIPETTSSYTIGLMRLQFWRDAITKIFAGSPPKEPIAILLASAITNLNERTQGQARISRAWLNKMINAREQTLTNDPYPTIAALETYAENTYSTLLYLTLSSLPMTSITADHVASHIGKAAGIAAVLRGLPLVAFPPPQAQSPTQPASGNFGGNKQGAVMLPLDVMAQAGVKEEDVFRMGGDAPGLRDAVFTVATRASDHLITVQQMLSNLRAGQDVGHDFEHADEEGHEYLANRDQRDESPLDEVNRAFGVFMPAVSTRLWLDRLEKVDFDIFRPELLRSDWRLPWKAYLAFNRKSL

SEQ ID NO: 42898 - protein, 1083 aa, A.fumigatus
HTCTNRAVPALPRFNEIGVQQLSDHVYSQVFPNQARSPDPVLVALSKEHLSRHDLLGKSQDAAEPIAFDMPALQGQSMDEHFFKLGMDASEPYLTYAKSYTTVNSPQKPREWVKRSGWTKYNSDGSWEPVDAPNEPMLTFDTEVMYKEHSFAVMACAVSPTAWYAWLSPWLLGESENEVQLIPLGDKKQPRIVVGHNIGYDRARVLEEYGMEQTRNFFLDTMSLHVAVNGMCSQQRPTWMRHKKNKDLRDKIANESNSVELAALLESKMLSEEEEELWVGRSSVNSLRDVAKFHCDVTIDKSQRDHFGELNREQILGKLEELLDYCAADVAITHRVYKKVFPNFLEVCPHPVSFGALRHLSSVILPVNETWKEYITNAEATYHQRVDDVQRRLVELCNEALKVKENPDIYMNDPWLRQLDWSGQEIKLVKGKKKGDPPRPAARQKKPGMPQWYKDLFPSATADINLTVRTRIAPILLKLSWDGYPLTWSDKFGWTFKVPKDQVKKFENQPVVLCDMSEEKNLELRNDRKHVYFKLPHKDGPQARCVNPLAKGYLQFFERGTLSSQYALAKEALEMNASCSYWISARDRIMSQMVVYEDQVKQSGSTGEKSNRLGFILPQIIPMGTITRRAVENTWLTASNAKANRVGSELKAMIKAPPGYVFVGADVDSQELWIASLVGDAQFQLHGGNAIGFMTLEGSKAAGTDMHSRTAQILGISRNDAKVFNYGRIYGAGVKFAATLLRQFNPSMSEKETQEVATNLYRETKGTRTTRRILSENPFWRGGTESFVFNKLEEFADQERPRTPVLGAGITEALMRRFINKGSFMTSRINWAIQSSGVDYLHLLIISMDYLIRRFNIDARLAITVHDEIRYLVKEEDKYRAAMALQVANVWTRAMFSQQVGIDDLPQSCAYFSAVDIDHVLRKEVDMDCVTPSHPHKIPHGESLDISQLLDKDQEAYLDPSVVPVSPPTPQKYTYTPRESVMATLQATNNPAFIKAQITKDDKELREIIKEVTKTKAATSSTARSFRNGSKSTNFPAAEPQKAILMDIDSGLYRDFRYLPQGSRHPPFNINRQTWKPRPAARP

SEQ ID NO: 42899 - protein, 72 aa, A.fumigatus
GGTLSNKFKDGLGKNVFELAANQPTRINLAAIILYSFNGAHGLLYFKIDPDISKPIVWDVLEKWIEICHNAC

SEQ ID NO: 42900 - protein, 1306 aa, A.fumigatus
QFEAAHKFIEEMTSARPKCGGSSRRSPSRRVSRPSMIRRIEFDAFCARSLTFPCHKFGHLISGKTFKMVFGDLNERPLKKRRFFVDEEDTHPPSSEAAPVTTNLDTSTISSAGPEGSDVRQQQLNGAVPFPNVKESSRESPGLGPEDKQDNLLKEDEENNGTVDYEILNHSPSIHAQQDQRVDQGLTNGFGGQPSGERTVSETQAFQSSGGFDTSTFASIIGEHLSPESLEKIRKASGDDLERAVNIYFDGSWKSSNNSLSQPLVAPHQQTPVNESISQTVNTKISKKPNQAPSSRCLSQSSRYIGAFGVGAWATRSGVGLLKHGEHVNVERARSQPVSKRGRGGKLITNQKGDVLTRFTNKSGQEIGRLPRETAEWVSTLIDQKICRFEGICVFAPDRVRVNDTIYLQLWCYLRKEAFLPRNLWNMGDDNRSTAFFEEQESAEEKQLRLRQVALVKLFDEIGLQPTTVNDMTKKHKKEGLLRAAEIAEQYDKTKREGKSNESSEDEESPELEEDQLDTLYKKAQSFDFNMPEAQPPPSFVLNLRKYQRQALHWMLAKEKDKKSGRELSMHPLWEEYTWPTKDVDDKDLPAVEGQAHFYVNPYSGELSLDFPAQEQHCLGGILADEMGLGKTIEMLSLIHSHRNVSPSRQGPSSSTELVRMPSSSSAILPAPNTTLVVAPTSLLSQWESEAMKASEQGTMKVLMYYGVDKSTNLQELCSAGNPAAPNIIITSYGVVLSESRQLAMFNSNTQGGLFSVDFFRVILDEAHVIKNRRSKTARACYELRATHRWVLTGTPIVNRLEDLFSLVRFLQVEPWNNFSFWKTFITVPFESKDYVRALNVVQTVLEPLVLRRTKTMKTPEGEPLVPLPRRTIDIVEVELSEQEREIYDYIFTRAKRTFNDNIEAGTLLKSFSTIFAQILRLRQTCCHPILTRNKTIVADEEDAAATADAANELKDDMDLQELIDRFSASMENADTAEAQDPSAKFTTHALRQIQTESSGECPICSEEPMIDPAVTACWHSACKKCLEDYIRHQTDKGVPPRCFSCRAPVTSRDIFQVIRHQSPSPTPTETDLYSSTPACSPHPAPRISLRRIHPLSPSAHTSAKIHAQINHINRVHAYTKSVVFSQFTSFLDLIGAQLTKAGISYVRLDGTMPQKARAEVLAEFNRTETFHQEEIDEDEGPDTPRVRISSKNSRSSPKSPAVLLISLRAGGVGLNLTAASNVFMMDPWWSFAIEAQAIDRVHRMGQLRDVSVTRFIVKDSIEGRMLRVQERKMNIAGSLGLRVGGDGSEDEKRKERIEELKLLFE

SEQ ID NO: 42901 - protein, 564 aa, A.fumigatus
SFVTMSTHSLDQARTIELPPVAPDERDIEANPRAPIAPPSPFSTPAKEVAPHSPETFTSAARIASHETVRHRVRRSNTARSYHPDSVAHEPHWQPGTEPGIDPNKSPPAYSADWAPHIPAELHRKCEIIVVDFSQHEMRQYELDNDTLEAFLERQREPWVQCRWINVNGLSWDVIRILGKHKGLHRLAIEDMINTTNRTKADWYSDHAYIVLTLQKLVKLREESSSDSEEEEEDGRISFGRDRRSSTSSGKTHSLKRPTKRSLVVAALKDLFTFRSAKETDDRYANGASVRPSSGRASSKAQSNLGDVVNAGHTARSIQRFRGGPNEDRIAFMERHAVLASKGLSVTLEQVSLFLHADNTVTSFFETSADDIEAPIVRRLSSSETILRQSCDASMLLQAILDAIIDLAIPVTSAYQDAIGDLELEVLTDPDVDQSKSLYILTSEIAVLRSCMQPIVTVINALRDHRSEPVSTPGFGLKQLGTTTPLSMSGFNSDAQLQVGVATPNLKSLGGSSVSISNMCHTYLGDALDHCITIVETYDQMRRAADNMIDLIFNTIGNFPGRTS

SEQ ID NO: 42902 - protein, 67 aa, A.fumigatus
RWMKLADASNARHLGHLTDEFGMLEKAPQVLPAHLVSAAVKEKKGGSLAAQLATVLSSLVQAHNDPI

SEQ ID NO: 42903 - protein, 658 aa, A.fumigatus
  UNSURE (146): Identity of amino acid sequences at the above locations are unknown.
RPGELDPDPESKPARPDTIDLDEDEKEMLSEARARLANTQGKKAKRKARERQLEESRRLAVLQKRRELKNAGINIKVVTRKKGEMDYNADIPFEKPAAPGFYDTTEEEARNERQREMFDPRKQQLANKRKGDQEEDADRKKRKNDXNGSSAFAAAARAGQMQKIREAEQSSKRRALVLPAPQVSESEMEDIIKMGMAGDRASKMSGDDETTRGLIGNYTSIVGGTPIRTPRAPPEEDHIANEIRNIRALTETQSSLLGGENTPLHEGGSSTGFDGIAPRRQQIVTPNPMATPFRQANGLGATPLHGGIGPGATPLRTPRDQFALNQMEGGQLIGTTPRDIRLHQKAVSQAIRSKLASLPKPKETEWELEELPSESAEPTVAAEISEKDAAERDRREREARERAAQAELKRQTQVYQRGLPRPSVLDIDALMARASQVTDPINGMIAKEAALLIANDAQKFRLPNGKVEGKARKLERLNDELIEAARAAIVAEVASSNQQQEWLQGFDDRWSSTHSNALPGLANYGDDDEDENMYRQEQRMIDAFENVQASLLATAERGNKLEKKLALHYGGYQNRAKTLRTKIVEASSALENSKYELNAFQTLQISEESAISRRLEKLRDDVAFVLKREREAQETYRIRKEELDELVAGTEAVVNGWH

SEQ ID NO: 42904 - protein, 136 aa, A.fumigatus
VSKYGLNQWARVSSLLARKTPKQCKARWVQWLDPGIRKVEWSREEDEKLLHLAKLMPTQWRTIAPIVGRTATQCLERYQKLLDEAEARENDELGLGGPSGGEAAAPSADDVRRLRYEVAPIGKDVRFADNFEDPVN

SEQ ID NO: 42905 - protein, 428 aa, A.fumigatus
RMQLEWIDASRLDLSHEVEWPQPEKPEKKKTGVGNKAPSKNAQKRARADSRDVSATPDLLTGKNVNVGKAQRPSKAGGKENRDGTPLSMPIVTAEAISTDGTPKAESDDVEMVDVSFTDGKSIKEEERALGLMSREEEIERLRTSGSMTQNPTEIHRVRNLNRLQMGKYDIEPWYFSPYPASFSDADIIYIDEFCLSYFDDKRAFERHRTKCTLVHPPGNEIYRDDYISFFEVDGRRQRTWCRNLCLLSKLFLDHKTLYYDVDPFLFYCMCTRDETGCHLVGYFSKEKDSAEGYNLACILTLPQYQRRGFGRLLISFSYELSKREGKLGSPEKPLSDLGLLGYRQYWRETLVEILMEPGRETVSENELALLTSMTEKDVHETLVVLNMLRYYVCALTPSHLKPDIPLEQLTDYLIERKLGHRSHRLRG

SEQ ID NO: 42906 - protein, 332 aa, A.fumigatus
PHSGVLAEKPSEELFVIDKKGSAEIRNAYFKQHKPLKADEILAQRSAIPAVDTRKRLNSKVTDGVIEPKSKRHKSDWVTRKEWLRLKQVAKEANPTQTAEESELYDPWADSEDPTPVEDPQFDYLEKPKPKVAPPTIKQPPISLAANGKPIPSVRKPDAGISYNPSFEDWDRLLQEKGHEAVEAEKKRLEEERKEQERQRLIAEAQNDDGEVKSDDESAWEGFESEYEKPEWLNKKRPARKTKAERNRIKRRKEAERKARWEAKMKQKEEQLEQAKAIAEQVQQRQLERSRESGDDSSEEGDDAALRRKPLGKARYVFLGLDFRISHVLIWQ

SEQ ID NO: 42907 - protein, 205 aa, A.fumigatus
PLLSAEIGKYVAMDCEMVGVGPNPDNDSALARVSIVNFNGEQVYDSYVRPKEMVTDWRTHVSGISPKHMAEARSLEQVQKDVAEILDGRILVGHAVSNDLDALLLGHPKRDIRDTSKHPPYRKIAGGGSPRLKILASEFLGLNIQDGAHSSVEDAKATMLLYRRDKEGFEREHLKKWPIRVVVDKKENGEDQKKKKKKKKQPRKR

SEQ ID NO: 42908 - protein, 1122 aa, A.fumigatus
HPSFTAVQPTPPKHLTDEELKQQYGIHMTSRIQEDGGGTEAKWADIDDDEDDWAPETIEWTDGTKTSLTTHTEAVHAPGQDTKTANEAKADSPAPEQAPATKEVTKIVTKPTTTIGPNPTVLRLGANAERQAKSATILSRGPNDKTSLSSTSPAPPSKSPWAPLPPVEKVSPVMPPVQAQPPGRAPVREHQVSEPPTGNVHPKEIAADDFNRSWKDTHSGTTRELYNSRSGRYEPVPERKAPWRAEQQGFRPSSLLQRPTPGEQAGPAEPSPAFQTHRSSGQDAGHWTRRRASSNVSGGSGSFGRRMSIGRPDGPQRTFEARRGSQVNGIMDPSLQNKESVHPKDASMHEASSARHPPGPTWPPRAAAGPPDSVANASRAASQSSVHPAPEAQDATAQAPQEDPVAMQERIMKEKRLEARQRRLEQEEKEEAAKRERIRQKLEALGPPPEKPKSKNKESREGDKAEAKATPTVAQAAQSPPKPPVPEPSGEPKQYGMMKVHHPDTVKKLVAANEKERAAERSAPTVNARRPASPARDPKLEATTGPQEPSDFRQSRLPEKLPESRTEEPSSQWKSNLSTSSSYSPWSSNTKLGAASSSIANPWKPLSNDKTLGNGIFDQALGGFPSRDISLRGPLGLDQPPISSGPQPFSAPSRPQPEPTSISPLPPTDVRHAQYDSMTPAVRPGPIGPPSVHQSHWQQEPRVTGTTAWNNFHAVAAKREAEENEKLLNEMNTMRDSQPLHVAFNETWRQVRTGDQSGQRQVVGIHRPTDTSSSISNHLPGFDHPVATLPFADTHARPLSSVPVRSSRFFPQATEQYKRPAFEEDEHFRSPSPPPPEELSSHPVYMSDSTRPLVHLPAPKPIVKLPPKVVAPPPPPPPPPTFASMVAAPPRLSAQAQPVSTATSWQEKINCLFGKKTVHEKKNALAVTSASKEPLDVQLHIAAVSVSLPYLAEDMTQVGDGIASAKQVEETEEIFEDREAGSLPVVRVPNAAPPAAWHAAPAPSQSRFRFKSLKPMQIHSIEPYILGLGDRDSSGNFRVSIRFPGAIAAKTVTLPKKAESQNPRQRGPSTFKLRKNTKAREGPGNSINKKTTTTQQNGGSASSPRHQPRNTTWAPRTSSASH

SEQ ID NO: 42909 - protein, 68 aa, A.fumigatus
GKFLEFPFGFFRLRERRQLATNSLTDGFLVQSDISRCGANQLSAFHLIERELISRSPERGCPWPDPTM

SEQ ID NO: 42910 - protein, 139 aa, A.fumigatus
CFSIAHIFGMDVNNLSSNWKKLQETLKKQSASSSSKKRKTSDRETQNVTTKKQKIETIERKKSSLKKKRMSEGQEHGGDESAQEPMVKTISHKSSTATISEQSRTESKPTKVNEGRSPTLVIPIQYIQPASSDPSSVQK

SEQ ID NO: 42911 - protein, 87 aa, A.fumigatus
LSQSGTPRSYDTTGDSGKLNKHFFCGDCGSSLYSELEIMSDKTGIKAGTLDGGEAHLRNKVDVEFYVKDRVHYLNALDNVRQEPRLG

SEQ ID NO: 42912 - protein, 229 aa, A.fumigatus
YCEEDIFASQLRESERECNVKSGMAGNPAVLSTIPLDYHISIINQLFGPGSAAPPAVRLPSYLVGLPDRLHSDDIEYLRCSGALDLPSETLRNELLKSYLLWVHPHMPILGLHEFLSAVAGDNESHRISLLLFHAVLFAASAFVDECHIRAEGYPSRSVFRESISCKVKVHFAPAPTTAVQTHLCRCFSISNAKMTDSLLLKRFCYGYLILSHTTTKKNSPSGWVSASL

SEQ ID NO: 42913 - protein, 186 aa, A.fumigatus
LARMIYYLVECCHLCTTWILHTGSWPKEQTLTRVNDLGWTPLVQVAHHGRDDIFDLAVKKKSRCQCKDSWGRTALSFAAEHGSEHKVRSLLNRKADHRFPRYRTPLTYAARNHHLQVVLLLLRHTEGVDFADESLRPAVTSAVAFSDVVFLELVIEKGKLSDSIRTVRRHFNAQQAWEFARRKVAA

SEQ ID NO: 42914 - protein, 160 aa, A.fumigatus
DSRRVDADLEAKNTMDETPQHCAAINGSRSAVRLLLEKGVNVELHDKSALVPLLLEASKGHTAVVCLLLEYSASIDPTNADGDTALMIAVHNGHHETILSLLARSVAIDCVNHAHQTALSRAAENDHDKIVEILLQYGTEVDLPNHTGQTPLTLSDTKKK

SEQ ID NO: 42915 - protein, 426 aa, A.fumigatus
EYILQSKGTFCPCPDHGGPNSFVQVLLDFECEDDRLATAQALLLWVSHPEPHHDQKELTQRLGICISMISSSQTQIVKANARKQQIWRRTWWSIYNHVRITSSNPLTLKHDPENGDLCDTPLPSTHDFRFGALSPNVQTLVGNCDFLRDVQYQQFLARLFIEKSKLCQVGQFPGPSGDLSDSSSRVVGLASAENKACPTEIAELARRLGRWHTQLPPALRHQSTTSTAVTELEKFILVHRAWLLLLYLASAYVVCTCSVGRNSHAEEHILNRTSLVFDELHRLGFINVLPNPSVAILMPAVEFHITAVESACPQTNGASQRMLQQFSEILHQLQGSSALAGRMIEKLNNITATETKDDLSRVIASESAIAEQSVSNADFVLDETDDFYSFLEFGMSFANVIPLVDNSPNIGLDPPLCNESYFSQLP

SEQ ID NO: 42916 - protein, 71 aa, A.fumigatus
RQGEEWKSLRKRFNPGFAPQHILTLLPCILDKTVPFFETLDRYAESGEEFSLAETCTNLTFDIIGTDLTVS

SEQ ID NO: 42917 - protein, 375 aa, A.fumigatus
KLCWCSHSGTGAVTMDEDLGAQLPLDKQSEMVRLYHELTASYHQKSSVRAKPSNPLVIWQQYKLARKLNAIIKNHIKRKFAELKEASSDEKKSRSVLALSLQGIEKLDAHVLDQTCDQLKTFLFAGHDTTSIVLQWAFYELSRTPRVLESISRELDDVFGPDPSPAVVRDKLLAPNGGELLSKLPYTTAVIKEILRVYPSSGTGRLVPEGSDVYIQLPDGRSLCIDGVLMYNCETLIHRDETVYGESKDDFLPERWLGDSGADRIPSSAWRPFERGPRSCIGQGLATIEAQVILACAVRQYEFAKIGLGEVARDNAGEPILGPQGQYEVKSKLFNVSLPVSFWDLSTALTFKLDNASDCKAGRWNDNESEVVLRW

SEQ ID NO: 42918 - protein, 122 aa, A.fumigatus
HRQSTSISTMTVCVIFCNLYCRTNTTVESIKNAASTAAYGAMSYYHGNESGQIPGAFPTKWWEGSALFMAMLQYQYFTGDHTYNSDVSLGLQWQAGDGDYMPSNYSSYLVSTVPNKLKVRCV

SEQ ID NO: 42919 - protein, 124 aa, A.fumigatus
  UNSURE (121): Identity of amino acid sequences at the above locations are unknown.
RSKGNDDQMFWGLAAMLAAELQFPDRSEGYSWLSLAQGVYNTQVDRWDTSTCGGGLRWQIYTYQAGYTMKNAISNGGLFQLAARLARYTNNHTYYEWAEKVWDWSCSSPLLNLHHGHGRTXDCV

SEQ ID NO: 42920 - protein, 156 aa, A.fumigatus
  UNSURE (108): Identity of amino acid sequences at the above locations are unknown.
DSDDEEEAYFPGEFENRISRLKTLSKVQNVVLQFDKRCGVSRHHWITKPPQTVAFRKKALSVLFEWLPSLEAPLQSLGIQHLQDVNIKDDELSERITKVLRNLRALSXSIVSEHNTATTDDPQGLWDRDRFSLFPESRSFFCKASVSVAETNHILS

SEQ ID NO: 42921 - protein, 108 aa, A.fumigatus
DGGIPGHTALHVAFSLAFPELRGEYILFTISVILINTLYLTESDTPGQYVSNEFGSSVTLRALQQSAMPSIYLEWLWLLSMTHGVLPCASQSNLARRQDEHEPPLTPT

SEQ ID NO: 42922 - protein, 61 aa, A.fumigatus
DIVNFLPCLFTFRVAPVKVNGAGVTLQPFSYAILLSFLPILFTSPRLSEIGRLKRREYSGR

SEQ ID NO: 42923 - protein, 82 aa, A.fumigatus
RFILQITIPVSENYPWHTQIQRDPFHYNTAPTSIDPRLILDLRFFGYVMPVYENYVEFSSEITDLFGMPQVRPPFQFPVLRA

SEQ ID NO: 42924 - protein, 139 aa, A.fumigatus
TWCPSRIGISNTEFSPGSMLNIASELGDFIPGGEPKFLAPGAATHICGTTRAGKEDDGHSVVDKDSKVWRLENLFIGGCGVIPTQNACNPTLTAACFAIASARKVVEEIQALKGQQYQSKRLHHGAGRIRSVLKSRGVL

SEQ ID NO: 42925 - protein, 381 aa, A.fumigatus
VTFTLSTPVNEISRFLNNLQERKLSRHSLWRQTLVICNPIVIFLNQARKDCSAIMTPARCIEASMSEQEGSHYVRTHEYTSGSAKTRLPISAPSFYDDDNSLQEVISHTSHDFQEGEFVCPGFFQMVNPGNFVHRVMAPDWDYMMRRQAQAILPFLYLGPVSCLKDKAWLAQEGFTLLLAIRNKRSAQARLVSGEKVGAELGIEADAVDVMDNQELISAFPYAIRRINDHLVSCGPAVHSNAPKKIFVFCESGNERSATVVIAYLMVMLNLNMAVASHLVQLRRFCICVEEPLRELLASFQSILDAKRDVYKAIQASTSDSTSGIPQATVSRKRNIADRFDEPTGSGGDMLGLEMDMNMNIMDDGAIDSRKPLAPFQDRSD

SEQ ID NO: 42926 - protein, 129 aa, A.fumigatus
  UNSURE (116): Identity of amino acid sequences at the above locations are unknown.
VSDIELRCALLRTVLRSANRDHLLTGLAGQELQAVPRVLPDWLIPETKAHLVQAGRALSDRPEQFERLEDEDDSPGLKERFNWYMKPSDKSNYKEILSANPNHRGENYCFHSSFSXLSLFAINPPPPPP

SEQ ID NO: 42927 - protein, 573 aa, A.fumigatus
STTEPPIPPNRRFAANIIEFLEPSNQHIISLPLLLKMPLSKENRMQMAISAYKKGQFKSKAAAAKVFGVSRETLRDRLRGIKPRAETRANSHKLTALEEEALAKRLLDADRRGFSIRPQFLRGMAHILLCARTNDPTSVIGVNWAYKFIKRHPALRTRYNRRISYQRAKQEDPKIIKQWFELVHATIQEYGIHENDIWNFDETGFAMGLCTTSKVITAVDRSERPRTVIQGNREWVTIIECVSSKGISIPPVVILKGKEHQAPWYQESNLPPDWRLTNSTNGWTTDEIGLKWLKEVFNPFSSLHSTGAKRLLILDGHSSHQTAEFDDFCKENAIICLCMPPHTSHLLQPLDVGVFGPLKRSYGKLVEGMMVAGNNHIDKEDFLYLYPPAREAVLNQRNICNGFKGSGLRPLNKDQVLEKITFQLRTPTPPPLIEGSISSAFQTPQNPRQLDHKVRSLQRSLQKRKLSSSPVSHIQHLEKAAQMAMSMNLLLQQEIKALRAENERKLKKKVRKHASLGNDLFLSIQEGRDRIQQLNEQVDEQVDKPIPEPRQRAPPRCSGCWTIGHTIRNCPSK

SEQ ID NO: 42928 - protein, 723 aa, A.fumigatus
HTPSIRVSRIGLTMRLRESIRPPERFNSELIITPSPKKTLREPRNPRNPRFVDYNPHLPPAVFPTLEPANLAQSRTGEQDRQKTEQNGVAKGLQRDTSSIDFHGSNTEGKETWEKVDDISIDELENIIASNGELNPIYVRNMTIMEAAETSSSSDMDMSDSDPDEPLTDVDGRHAEVCVLAEYTPYFRADSSQVHQVHSPSRWSDLSLSLQAEIAINLSQHYGWSTVYSKLGLGEKEREELQELIRRRDHQVAMEYSALHAMRAKQLRALLRIDNSSGSRNRTPHKLIFRRISRKTAQRLRGSMETDYLLCDVGELVNARRFLQRRGIDRHYAGEWSGSIVTWPRAEDGSDAERGESQRDSIVTGPVTPFGVGSITVNDHRHDFADSSRPNPATPPHRIIQTTEHNEGALVQYQKRDLPPRKLYHRGERDRRLIVRFKLGQPRAKFFQAWKKSAHPRRLIRSVPPLDVFYKSSSSPGEFDGGAGTTSTFASNSSDSALNIFKQSPRKAINEDWKRGLLELDDTSLSSCWRKFQQELQQATFDPDTIETDTIETDTIETDTIETDTIETDTIETVGVLDSGVDTDRHSELSEAIPCINLTDVHLPSRLTTPSRVMSPMSVDYIQSDEDDLAPFSGARTSRTDPVFDSPGSSCWETSSDGAAAYSPTTPLTTVTNTFEILEDNNSEKSDDDWEDAEEEEEEEEEEEDEMILVPAIGPVRRAAAQR

SEQ ID NO: 42929 - protein, 104 aa, A.fumigatus
DPDFEDIQLQYFQFRRLRISAMSNKKIEQWEIERYWEIFSSLANGHPRLNSSQAASVLRNSRLSDDQLEKVWDLADVDSDGELDFEEFCVAMRLVFDLVNGVSQ

SEQ ID NO: 42930 - protein, 93 aa, A.fumigatus
KHSISPSPLTTSIEPAKDWSERATPRAQTRQDFENIDLLSQPSVLTDEISAPKQHTPKDSTFCEPSILVHQNIPPVQTTGSLPSSPRGSTDPR

SEQ ID NO: 42931 - protein, 79 aa, A.fumigatus
PIYTLIAANFTTWCKYELFATTFNLGLRMRMLPCISFKLLYIMHVTAVDITIFGRFWGFAFYGYRKGGRGSKAPCSYCL

SEQ ID NO: 42932 - protein, 464 aa, A.fumigatus
RSVCDPLRDTCHGYFSSSSFFDMALILVLIALVFFSTGAYYLGSLKPASLPTSSTTTLFEIEPPLHNISPANLQAAWADFVEILGKENVSTEHGDLDVHSGSDWSSYTLKKDERPFLVLYPSTTEEVSRIMKVCHQRVIPVTPYSGGTSLEGHFAPTRGGVCIDFRRMNRILELHKKDFDVVVQPAVGWEDLNEELSKDGLFFPPDPGPGAMIGGMVGTGCSGTNAYRYGTMREWVLSLTVVLADGTVIKTRQRPRKSSAGYDLTRLFIGSEGTLGLVTEATLKLTVKPKSQSVAVASFPSIHNAAECVTRVVEEGIPVAGVEILDDVQMKCINDSRTTRRQWKESPTLFFKFTGTPVGVKEQIELVRKIVSSSAGQSFEFARGEDEMKELWSARKEALWSVMSMRRGPEDRVWTTDVAVPMSKLPDIIEATKQDMTESGLLAGICGHVGDGNFHGTTPAFFHH

SEQ ID NO: 42933 - protein, 120 aa, A.fumigatus
VKVQTNIFPIFLAIILFNEDEKKIAEGVVHRMVKRAVEMEGTVTGEHGVGLIKRDYLQHEVGETTVDTMRRVSYESSCMTAFDPDVDSMQIKMALDPLRLLNCDKVVRVEQPTTVELKKW

SEQ ID NO: 42934 - protein, 602 aa, A.fumigatus
EGAGGDYGIHAKCISILTQVCTKSSALRLPFLTTQDSITFLIHIWLRHRNSKRAFQTQFKRWGFPSKQNPAHKNAELVARIKQLWERNTSQRDMLRVLNEEGFEIKERELMRVRAKNRWLLRVPNGMKSQAAIRPSMQLPEDEGLLALQQEVYKSTEPYYDPQNVPADSSVMQPPSPSLSVDVLAKRQERLERLKAESAERWASRKRRRRTREWAGLPADPPGPPRFPSETTIDESKKYLSLDNSSYRQIRDQFQRICEEAGFIKKTVAGPERWQEAKNRLIQESEHLQRVFWEDPNRLDAKSLALDVVCTDVTKRMRTLERRMTIAEAKNALGINPEESRQIRNAFYNTLKAAHFTSKLEAGDEHWKQLKEIWIRDSELLQRILAPGSADPEHATKLKALEVLCRDVMKRLRDDQTKRDPSRKKSITRTNISSPDAPGTNDNSTFSSITNGISTLASQALASAPMTSGDLSDMQIDPSLLQAANDTSFASATHDTGNPFGYVDPILDSTSLQVPIYVRIYPPDQVHEETKTIVDKLATKSVTELRQLVVSRYPGSIVTKIQGIDQDEHGNEVTFNIHDDNELDAYLTHVHRRRAYIVCRLA

SEQ ID NO: 42935 - protein, 100 aa, A.fumigatus
KASSVSIYDPDFARSYAYILLIGTILLKEIGQNLKYDVFCLPAVGFIVPTYPQYIQFALPGQLDRTTGLCPLCKTFPTVQSLASPVSAAVPTFHHASRLP

SEQ ID NO: 42936 - protein, 75 aa, A.fumigatus
QSRSIDDRPAKHGLETMDILDSSLTIPSRDQTDDVDTGIYDSERPLTSKITKPEQRISHFNQTELRVSIIYTRKS

SEQ ID NO: 42937 - protein, 66 aa, A.fumigatus
GHDFGPSIKEGHNAWVIIRIVDVTEYHLWDKMCELGILHVSDDKEGFLRIAQLGRRLDWQCSIMAK

SEQ ID NO: 42938 - protein, 316 aa, A.fumigatus
LFRIGCIQVHYWEHGSIGQFVVKGPMVLGHESSGVISKVGSAVTGLKVGDRVAMEPGIPCRRCEPCKAGKYNLCEKMAFAATPPYDGTLAKFYVLPEDFCYKLPDNISLQEGALMEPLGVAVHIVKQASVTPGQSVIVFGAGPVGLLCCAVAKAFGAAKIIAVDIQKARLDFAKKYAATSTFEPAKVSAVDNADRLRKENNLGVGADVVIDASGAEPSVHTGIHVLRPGGTYVQGGMGRSEIMFPIMAACTKELAIKGSFRYGSGDYNLAVGLVASGKVNVKDLITGVVEFHDAEQAFKEVKAGKGIKTLIAGIQD

SEQ ID NO: 42939 - protein, 687 aa, A.fumigatus
PLNPLDLGLKNYIASEDLSIGTSAGLVRRVFKRSVELGRRYARSRNDDELHEALRLLGTGLHCLEDYAAHSNYTELSLIELGESTVFPHVGRNTKVKVDGAQDYIYPIVTGTFGGVDFFHSVLGELSDKTIQSEVQSLEGVINESQSGTPTESLIQDLLNKIPEGLIGNSDDQANKMDEFKAKSQNAKQQNQEISPREPEEWTRYLDNVHQQIYPVLEWHDELIKSINRAIEEIPVLPELIEQFQEQINIFVFSILAPYILPIIRQVKVELQTGSSEVIESSRAQQHVVFNDDDSSNPTHSMLSKDHFSNVLNEPAGQIASRVVKWTVPQLMECWDDENIDVDRVLDRIITGVFHHPALRQYGEDGASDIRQIMFDTVEEWWGKKDEAERESLREQLSREGVREGKNHKEGVHDSGHGCGKPLTLHKAKTSPGESYKPSTSGLGKIAAEAAGGGALGSLVGGLVSGVGSILLSDSSSRRSDNERRETDFQEDGLPGQSRRQYGGQSGFKTEADGEVRYSGESRYERESRQGWNEGRSRDDDDPTYENTSSYSRGEGENDHERREWSQDCQRHGPRGGRQNYEDAHANLYRRSDLESYETSERYLSVENRRVVEYGRDRPDYDGSESLWSQKTQAGYERADDDRIDYTNSRYDYDSGRSTYDTEQTGPYEHSRPERLVKHTSGDFGRR

SEQ ID NO: 42940 - protein, 87 aa, A.fumigatus
AKGIQRHFYLHRVNVGIKSSHTARLITYPPHSVHRGFPNLMLKIVPLDEANPVFASDCAFHFNCSLDHSVHNTFRNFLFILIEQDNC

SEQ ID NO: 42941 - protein, 85 aa, A.fumigatus
NLSFVLEGIHQVKFEDRPIPELKDPHDVLVNVKFTGICGSDVRICAFSLTLYIHLPCGAVDQADCFGSVAFRSTIGSMVQSASLL

SEQ ID NO: 42942 - protein, 573 aa, A.fumigatus
QDSGNYIISGGDESVMVLWQLDTGRKQFLPHLSSPICNLVVSTTGKAYIVKLADNCIMVLSATELQPYVTITGLQLCHQVNKPADAAMPESRVALQPPAAVLHPQFHDRLLVAVPASRQSARNYHSTTSSCMLQTYDIRTNSQISRQALARTNATTLRISPEGTEIVTPNVSHLGICQDGKWMATIDDWIPRPEDIRALDSTSASSGSHTLHRETYLKFWRWDEVSNTWELTTRINSPHSFNSVSVPILDLASRPYSHEFATVGCDAVLRFWCASNRPCLGSATERSENRYQTWKCRGTIDLKCAFIGGGTEPANAACIGFSEDGSVLAVCVQTRSSPDYGLVILVDTQNCRIHHSRIGVYSGRPCVSKFLGRYLVILSLHSTHIWDTVGDIVRTINSSGIQDNTPCDDQLLAVSSKSQTCAVASRVPRHLAGTRRSSGSLFDIRVYDVQTLSLLTRQSLKHCPVSLLSDPLTGDYIVVDARANVLRLSCSDKAPQSVPQSKDGISCNYGLGGLFGTRSRAMSRHDNLQPLPVNGSSSAPQPFGLPGVFTDTPPFVLPPTSVLFKNLVQNLTT

SEQ ID NO: 42943 - protein, 321 aa, A.fumigatus
SISIPPSFLLCFVRALSHTFSFLSSHPYTERIYYLICLWVAINCQPLLHPPLIPQKFPLTLRPKGRKNVMAAAPLDSSSTPPDAPQSTDSTRPHGDFMEDLDPQCTRKRPRLDSGSGAVESLSIDEAAISRMSESTPAAPATPGTTDHDVPVSAAPASRVTINVKSPTSDTMATDSLNPTSEHPGAGPPNATPAADSPQIVSISSTPEQSPEIEVADLEDMDQDPNTSTWRTLGEALQDPVTPEVVQLQEQPPLSASFPKLRDADDPRENLEGISAIIEKGMQSVSNILGACLKLLGTNGTGPGRKRPRCWCLLGCEALVR

SEQ ID NO: 42944 - protein, 95 aa, A.fumigatus
LNQMLSFRPLLTPSSSDLAEKLIDNYLFPNLSEESDNLIVPQIPVMHAQTRQELYGILSLLCKNSDDYCTVLDCVKELIPAGTTFLFLASAAWLF

SEQ ID NO: 42945 - protein, 231 aa, A.fumigatus
  UNSURE (209),(210): Identity of amino acid sequences at the above locations are unknown.
LAPRSDKEKTIEGDLFTAFVAAGAISKANAADPKKSSLVRCARTDKGVHAAGNVVSLKLIIEDPDLIKKINEKLCPQIRVWDIQVTNKGFSCYQMCDSRVYEYLIPSYCFLPPHPSTYLGRKIVELAEKDRDLEAYRARQEEVATYWEDVDNERIKPILDTFPEDLRKLVEKALYFDEERAPEDEDATQKKEPQQTSSKGNPADSEQTXXDLTTDASYEEDARKTRISEGG

SEQ ID NO: 42946 - protein, 723 aa, A.fumigatus
HSTVAQLTLSCRYRACLKEVPDNLIFHLKRFDFDMITMMRSKINDEFRFPEHIDMSPFKVEYLSDQNSNVPEDVFKLVGVLVHSGTAESGHYYSYIRERPNAGGRGSWVEFNDSDVSRFDPSKIADQCFGGYNDSVHPANVNQVRFNKVWNAYMLFYQRISSMESEKLLYKPSKADHPVHVSLPIPLSNHIAMENEIFIRTYCLMDPYHALFVRHLLSRLHDNGITNKRPKLDQDMVFIALDTLEQLIARTREPLGLDVLVSELVGVINELPKGAHRVLEWVVERSAGIRNLVLRSPHASVRDSTIKVIMRALERLQELRDEAHLDERAKEKWHMRYLDGFENVVATLDGLWPVLHTTSRSWDDYFTFLISLAKLGSYETEMILNSGFLLKCLEIVWLDGEDSKRLKRQYLSYCRLVEKGRKFSHRRLMDLLAFLLTKVDLTVAPTSDDERRSLPNGKFSLTITENVFVRSLGRDRELSLLKKILHTNHNPHASMAIVELLLDSEPEAGLMDPLCKVLEDGLRVEPAELCAPFLEATLILCQRSPDENRFVALIDFVAKGIESFNDSGGREHLAFFTSLLTSRNERLGLEKNWFLAQIVDKIPDWAPTLLIFPDRTVRNTTLALLHQILFSVEAEDMGPDWQSRHAEIVKELVRNSVEKLRKTFLTGSVNNVEARVIESVKAVIDHCLVTYFDDSEEDQEIVRQAQGLFAPDSLPTLPLYPGS

SEQ ID NO: 42947 - protein, 198 aa, A.fumigatus
PQMHRTKKMRAKRESPKAARKSSPPYTEAKRAYRIPVARLDRLQATLDKYVGTNNFYNYTIQKTYTDPSAKRFIKSFKVDRNPIIINGTEWLSLKVHGQSFMMHQIRKMVAMATMLVRAGCDPQRIVDSYGPTKIAIPKAPGLGLLLERPIFDGYNKRATTTLGKEPIDFSKYQKEIDEFKQREIYDRIFREEEQANA

SEQ ID NO: 42948 - protein, 946 aa, A.fumigatus
RLFTHYRQPLEPDDGQGIWCCLEEFLINFTLLGFRLVRLDILTLKQLEKNTDMQAVDLMSRAYLQALGWILQLHGIPFYRAMERAHGSEIVDLVVQLNSRVAFLPIGTMHLLSEYAACLLALVSRPQWSQLSSSLVHTLTIVHNIMDSGVEQWKIREEESIAESASFPFLLKQVYQFARDIDGQYQAHIAKKLPWVTSDASESILRCISGIYLAVSRDSSFTSQVAEDLLIELPEQSSQDERAWIIYYAWRFAVLQKHIKDGRMELRVHGIETMQADLVNVWRQYIQPNPTGTEHPLVRFLVGFLRENKIVDYIVGVDSHPQLISRSGNVVGFLIVTSTYGDLDTDTVWKTVTESQDPRTVSEVLGMLTRTFHMHSPLSSALIYLCSKLLELPLSRFDARMVEFCEQLLYQVREKQGERNRHDLLDASHVDAVPLRLCVRLIRESAAFEEFSVEHKAFLQRFASSQLSSLISVGLSESDKMETYERCIQDIAEMNQFTVGSIQALNALLPVYDTQEIRKLATDFNLSALVIAEMVHTVDLKQTDFADSFSKTGFISRIQLLARIIDKVPDSVTADLADVLWEKVLVSQTLVEQGRRAVWDMLCELMRRSPKRNPFIERCIQEYLPKLSPNDYSPELLAFAKQAVNYEVRFNPPPIAKEDEVVSIPGLDRIWNFILTAPPGSIETDAINFAIEVYLDHSVINRSPRSAVEATHIALVDRCVEQLKSAAAHLKPAIGSVANGTDESMASDLSRGESRADALRFSRSLLFLRQFLQGLRSRPQYSPPQNSLPNLPDHPVKGELIEIRYQTFNGSSQSKFRSLRIGDLATAAELVEKLEQLTGFSKFSTITGGRRLDLLEKPNLTIRDLKIGSGLLLIRKNADSREVASTGRRPSLTPVDSEVLKHFDDLYDLLNLQDYLAREVSFFGGGGALACVSLKIWLLTSATTDL

SEQ ID NO: 42949 - protein, 232 aa, A.fumigatus
RADPCRYNFPVPSKCGVAILILINCCDLADYTYSSSWCFDRHKMIRAPEGYAGLKNLSNTCYLNSLLTQLFMNVQFRDFMLQLHLSDPDTSQRLLAETKKLFAYMQETWLRNVDPQGLVNNIRTYDNEPIDVTIQMDVDEFYNLLFDRWEAQITGAEDKKKFRSFYGGQLVQQIKSKECPHISERLEPFSAIQCEIKGRASLEESLQAYVEGEIMQGGKGLRETKIADWPSF

SEQ ID NO: 42950 - protein, 95 aa, A.fumigatus
LSSTNLASRHMVDKRARNEQQNEAKRRKLENGEEVSDPIYATHFSPEDIENEQRRPKKKVAVLIGYAGTGYHGMQLYEPWTPMGLWTTILTCAQE

SEQ ID NO: 42951 - protein, 88 aa, A.fumigatus
SFPFSESDADEVNRFSVFFNHIDHFSQETFLYITSGGMAASKLPAPPTDATESEQKEASKRNPKSQREALAAVESESDGEGVQGEEGG

SEQ ID NO: 42952 - protein, 233 aa, A.fumigatus
NCSSRSTRSRFPPTTSRRHGSTRSTSSATNKHTQPEPPSSSPRKNKKPSGATSRPMPPRWKSPSPPPRRRAPPSKQKKPRARPPSRSKTLFPSGTPTRPFQPPPATSATSRPRQTSPSNLKSRRKKTANPRSRTWTTRSPHTTPRWNERKPCRHNATPVAPRRTIQMTNLTRNSKTSEVSPLATPLLQPSWAGLPVHLPLRQSASSASSTRIPGRVRLRPPWARPIHPPTRDR

SEQ ID NO: 42953 - protein, 276 aa, A.fumigatus
NTSIYHSPRVSISFTCLPTIPLPYPRDKQMLTAGLGERSYFALTLDNGLHCVTTAWLELGKTAPIGQEFELIVQNDLEFQLTLQMKVDDAKFRAQEPAAPASPAKQKASTFSRVFASPRKRKEMEMKQQLASQQQKNKDVNAGVWDKLRTLIARDGSFGRAYVALSDHEKYAFGRPYTVDVACFNEWAVDEQPSSVKSKKSTSSATSQRRPPYKIGKLELQLLFVPKPKGGKDEDMPKSMNACIREMREAEAASSRTWEGFLSQQGGDCPVSVPSD

SEQ ID NO: 42954 - protein, 122 aa, A.fumigatus
HAETAQADRLGRDSPQRLRDGMAAQGRRHPQPTNTPNQSRHRRPLEKTRSRPGQPPDRCLRAGNLPHLHRGEERRRASRRSRAQGRPREAKRSSRLAHPLDRFNHRRQRQLHQDRDRRRHQT

SEQ ID NO: 42955 - protein, 91 aa, A.fumigatus
VCTYVVRFRQYWRRRFFKLQGSKLTAYHETTRQPRATINLSKAAKLIDDRSSLIQKETTTKGGGRRKSAFAEDEEGYMFVEEKLPYPLWKR

SEQ ID NO: 42956 - protein, 383 aa, A.fumigatus
LTFPPCRSTRAEIRDGSTRPVNREYYYIPLHPVIDAIKFKVSKLTSTIKAQYTPSEERKEYVCLRCGAEWTELDVLSLYSDEGFECQNCGAILERTEDVKGAEGIDRTGHEKNSKLMAQLDNMLKLLKQIDSVEIPPNDFETAWQHKVDVIRNQQTHPTRAAIVVPSKKQEAVRGNLQTDASALEISLTSTEEKSAAEQAEEAARKAALEKQNALPVWHTHSTVSTTAGNVSYIKTETDVAIKPEVKEEEDRKPKIEDLDDKVAAYYAEMEREKALQAQRDASSAEEDDSDDEFDEEFEDVGGISASDTASPAVMGGPTSAPTSAPVGIKREFDTDSGTSAPQTAVGTPNTPADEGPVAKKIKMEPDVKKEESDEDDEEFEDV

SEQ ID NO: 42957 - protein, 119 aa, A.fumigatus
EPPPMTVKAGHVSASQAWDKHSFNHFAAYHTRKLEKQRSMGFAVLAGNSYRTRVQVVPAVFLNSGRCEDRHLKSLTAFDAVPLKAKSLTFPVNVYKSIVLVAATRNDQWRIYVVVAPFS

SEQ ID NO: 42958 - protein, 133 aa, A.fumigatus
RILCSNSEFLMRIPGGIFRLELFLPEDYPMTPPKIRFLTKIYHPNIDRLGRICLDVLKSTSFCFLRMSAQANSISDNWSPALQIRTILLSIQALLGAPNPDDPLANDVAQRWKEDEQAAIQTAKEWTRIHAMT

SEQ ID NO: 42959 - protein, 88 aa, A.fumigatus
RGLLRTAPQLCRPHEQLAAATDSTLPPNANRQNLVSTGCASPTFKMRTYDDSFSGQKIYPGKVRFVPSGIINHPAISTPILYERDTDS

SEQ ID NO: 42960 - protein, 78 aa, A.fumigatus
SQVAISLTEQPSALCPQESIESHPLQRSPERVQPQSTYHLDPTSYTSPAAMGKVHGSLARAGKVKSATPKVSSSCSSL

SEQ ID NO: 42961 - protein, 276 aa, A.fumigatus
LTMSPDPHAADRKAQKQREKKMNAERLKYQKQQSEYFPLTDSFIVPKSRVARALDTCVRYLQTTYCVVSFPTHHFVVSGIKNSGKQLKLRSRSFESESRFSSCDVTHPASDLPTVPNLKDLPEKVRKRPERSSQVVNKASISLSLLCCPRNCGSVKLTVKQKDPARTSPKESSFTRKFSRTMTDDSVKKVSSMDRKSWQTQSSSAGSGGKTRSIRSASVTATGTDLGEGDAATRLEGGLKKLTISEGLKREGKPAAISTAQPKVIKCLRSPGGKNY

SEQ ID NO: 42962 - protein, 166 aa, A.fumigatus
EPWLSCQLVPDSYRQLTQRQLEVIRHIVKNIFQGQSDEDTKTGKALQNAKKWDTKNTKCIKCFGDCPVCSKACCIFDVARRTAAQADSTPEHAEAANQILKLIQRLGNSVLEETTYSLCTTPGGCGRYVCSDCWGICPVELCHDFQCKVSNIIFLFSPCQLPMIEC

SEQ ID NO: 42963 - protein, 62 aa, A.fumigatus
CTLRFVDSTSSPAEKQRDVVGMIWGISGFKLLTHTLACLSSHNSVMLLRPSYIELSAPKMIT

SEQ ID NO: 42964 - protein, 107 aa, A.fumigatus
AIADGVCFHHEQEVAKKRTRRVVKHQRAIVGASLDVIKERRSMRPEARAAARQQAIKEAKEKKAASESRKKAEKAKNAATAAKGTAQRIQSKQGAKGSAPKVAAKSR

SEQ ID NO: 42965 - protein, 327 aa, A.fumigatus
LQRIVDIPLVEESVDSGLVSLEAFDKVLLEALHAIRENAHAVQQVADHQRLEDVQFELAVHATNGSGNVVAHNLGADHGKGLALRGVDLARHDRRTGLVLRQNQLSKTAARSRSEVTDILRDLEEGASQSVQGAGGLNDGVVSGKNLELVGGGLELGAGQLGDLLSNTLSETLEGVQTGSDGGTTLGKVAEVGEGSLNALDVAVQLSDVARELLTESQGGGVLQMSTTDFDDLVELLDFLLESVTKAAQGREQSVLELQDGGDMHGSGERVIGRGGHVDVVVGVDRLLGAHGTAKDLNGTVRDNLVGVHVGLSARTGLPDNQREMVH

SEQ ID NO: 42966 - protein, 104 aa, A.fumigatus
RAQNQHSPPREVCLQSFAIIISEALTCPSLMLVTCLNPVIGYDMASKVAKNAHKKGITLKESAMELKALSEEEFDKHIRPELMLSPKGEEIEVMKSCLVAGAMI

SEQ ID NO: 42967 - protein, 354 aa, A.fumigatus
  UNSURE (13): Identity of amino acid sequences at the above locations are unknown.
SLPYARFSPLWRXPEVAEGKLMDHFPLVVWQTGSGTQSNMNANEVISNRAIEILGGTMGTKKPVHPNDHVNMSASSNDSFPTAMHIAAVLELENTLLPSLRSLRNALQKKVEKFDKIIKIGRTHLQDATPLTLGQEFSGYVAQLDRNIERVEASLPHLRYLAQGGTAVGTGLNTFKGFAEGIAEEVTKLTGTEFKTAPNKFEVLAAHDSIVEASGSLNTLACSLFKIAQDIRYLGSGPRCGLGELILPENEPGSSIMPGKVNPTQCESLTMICSQVMGNHVAATVGGMNGQFELNVFKPLMIRNLLHSVRILSDGMKSFEKHLVEGLEANEPRINTLLHERYVYNPLQSSFLKR

SEQ ID NO: 42968 - protein, 1131 aa, A.fumigatus
FLLLAHVRGGRETARFRKRFGTTNPFGVAAIIDMMEPRPLASAFESPTFGEDSSFHVEQPVGSMSISPCGRDVVLASKEGLHVIDLDSPYSPPRYLPHHTPWEVADVQWSPFAARDYWVVSTSNQKALVWNLAMQTGENSIEHVLHAHTRAITDINFSAHHPDLLATCAVDSFVHCWDLRTPSKPAISFSDWFAGATQVKWNRQDPNVIASSHDKFLRIWDTRMGAYPIKSIEAHDTKIYGVDWNRVRPGALVTCSLDKTIKFWDYTVDDEVPEKVITTPFPVWRARNTPFGWGVLAMPQRGNSDLHLYSRRSSDGTNLTENLPLVHSFPGHKGQVKEFLWRARGGVADGIDYREFQLVSWGTDKELRLHRVDPDILQLVGYERGKSFVSKLNVTRQGAVYKTFRDANGDDGYGEHDSILSPNPKLAGGTGINTISVPYSRPWTQGGNEDSRVGMQRRSNFRADTNPISWMRGVKISGWDIETLGDEITHVGEKFTKVAFESVDIRQRKATISLHGPWGPEGDSLFLKVDIKFPSDYPKTSMPTFGVQRTAAVTDQLADKLISELRTIAETYLSHKRGCLEGVVRYLLGESTIEESIAHILGETAETIKSPINGDLGDDESSDEDEVGMSQSQELGMSSELLRPVNNANVMVPVAKACGALWANDGRLVCFFPSKKEKSSNLIENLGLKEMSRLSRADKVFEGFGRIQTSSPGPKISGTLASTDDGTSEYSDDSDAETSSSSGSSDMLSGLQARFPTSQTWRSAGSLGIYRPRSTDHSQRSTAGALTAKSSDSAQNIISIHDFSDLLPAKRELARRYRICGKVTDVCAHNASAALDLGYHELARIWGLVKLILQHQNDSLSSTRSEMMQRPSGIQRKDSAVDLSFDQSNQEQSRKESANSANQWGDHPYGGRWLIPSLIDHFERIGDVQMIAMLSCVLQQPKSEEISKEATRNRDPVSSGMGHQSFPMDIFPTQAATQNKSQAVTPLASTPKEGHPTPITQSSGRSSSEFWRADSTPPYSTGTTPPLASRVGALNAERKTMSHNISIAASPDQQSQPRSGSGFGSALASSFSRSFTFGPSSASPTAVPSGQKKQSPSGSLITSAFAGKPATAVPDYLAPSAALTSQTHSDI

SEQ ID NO: 42969 - protein, 243 aa, A.fumigatus
IPCFVHPLIPWYLTSRVQIKSPYNNSSLINTPPEGAQSTTNPPLQTNSSSSILNCTVTDRINPKMTNATIAPTTTAAPVTKSVDAPTADENTPLFSPSLISPDVLAVLPADYTIRPLCRSDYKRGYLDVLRVLTTVGDINEEQWNSRYEWIRARSDEYYLLVVCDGEGRIVGTGSLVVERKFIHSLGMVGHIEDIAVEKGQQGKKLGLRIIQALDYVAEKVGCYKVCSVFCLLFGACRVGDWG

SEQ ID NO: 42970 - protein, 1184 aa, A.fumigatus
VVVTATAERPHSHYLTLVLFAFKKKHGLNVMKDICDVFMREVRALTPPESVSESEHDVSARLTSAYGGIKIILSFFAELASGKNIVDSSQTQAITTGDRDRDRPDYFQPGQFLVDLRMEILPMARELWNSDFATQSSSSVVKCLVDILRSSLDGEYETGAARRSDTPPLLAEATRKTVVVNKDRVTHLHGEKGFDKDLATEALYRCNNVYLAAEEYCKAQKRLRAPPRVPPNPEDIDSAGGETSEDTALGDAPPFNSGFLERSTLAMLLAQASGRSSDDASRQQQDQDRPDNELGSGTEFLARALTQILNDEQSVAGEDRDMSSHRNVRNADPSGNSSESSNQAGSGQTTGQSSRRRELTTVEDLDGEREKVRSNLIERCLDVLNEHHDVSFELSDLIASATKKHSDPESFRREVGEILVQSLVSLQMENFQVAGKKVAAYAHLLALVLQDKDMYTATLDELKECFTTFLGFIKVSPEKSADEFFPWIGHVLLILEKLLSDDAQPPQIRWNLPDSDSSTPDDAGPAQLEEPLVSLDQKTQLYEAIVEILPRIGKDDTLALSVCRILVILTRSRSIAVRLGEKRSLQRLFVMVKQLSSSTNEKLQSAFMLILRHIVEDEDTIRQIMRSEIVANFESKSSRQIDTTGYVRQMYHLVLRSPELFVEVSNEKLKLQRYDNRQRPQILTLKSDKTSSAPGSSSAREGAEGMSTGNNNVSNGAPSLDDKEKSKAADLKPPVVENPDGVIHYLLSELLSYKDVEDKEPPAEAGDAAVNDQSETQTDIEMATDEPTPSVSSAELAGARTSKKQEKPPFKADEHPIYIYRCFLLQCLTELLSSYNRTKVEFINFSRKADPLATTPSKPRSGILNYLLNVLVPVGTMEHDESIAFKKRSNTSAWTMRVLVALCTKTGEFGGTGRRRNDQTANEEDEPELAFVRRFVLEHALRTYKEANASNEQLDVKYSRLMSLADLFDKMLSGYAFVSGDTTFPSSTRQLAKTMYEKHFIAALTASIAEIDLNFPASKRVIKYILRPLNKLTQTAVILSESSDISSLGDTEEDEISSATSVSDLDDDREETPDLFRHSTLGMLEPHHEEETSSEESEEEEDDEMYDDEYGDEMDYDEDMPEDDGEVISDEEDEIEGVGPIEGLPGDSGMDIEVVIDDEDDEDDEEDDEEDDESDLDDDEIPAG

SEQ ID NO: 42971 - protein, 1321 aa, A.fumigatus
HCNSIEEDLIDPWGWDGDEPPLHRGHHQRFRGPQPTWAAVTGMVPNRHGIVPIQPYRFHRTQIPARGTDDGTNPLLVRTDRSAETAQPRLPGNEAFTDWVHGMEPVSTGRLVPMDSPVSFMNAIMQAISGQATPGFGVITRPDGIHVHVDRRAILPNRSIQDIFGLGRPQAPPSRTRDDPSQAVSFALATTRSRWQEEARILFSSTYVEKTQRVVNSLLKILVPPAIEEEKQREKQMEEERKRREEERAERERQERIAREEEEKERKRKEEEENARRQQEMEQQEAERQAAGIVSEPMDDVQETAIEEAAEPSTQAEVGPSEPVRRVHTTIRGRQLDITGMEIDPEYLEALPEELREEVIMQQLAEQRSQAAAAGEEPSEINQEFLEALPPDIREELLQQEAADRRRRERESARRQAAVANAPAHAENMDAASFLATLDPSLRQAVLADQPEEILATLGPEFVTEARALPGRRLAQFGDITRADHRPRNEPAEDQETKKPQRRQIVQMLDKAGVATLLRLMFMPLQGNARHQLNDILHNVCENRQNRSEVISLLLSILQDGSVDVPAIERSFAHLSLRAKPSSVQKTPQSVKRNMAFHTSSSVSSEVTPIMVVQQCLGTLSFLSQYNPHIAWFFLTEHDPTSTLKLKTSRKGKGKEIKANKFALNALLNLLDRSLIMENPNCMEQLSSLLNSITQPLTLLLRREKEKQEEEEEEEDKGKKPEQAQVVEPSADQEHAVQPSESTEPAAGTDTTMTDAPAATFEDAEQQVAQTVAQEDAAPVEADKPEATKETVEDEKPKRKTIEPPVVPDQNLRLVVHILAARECNGKTFRETLSTINNLSAIPGARDVIGNELVNQALSLCTTILTDLDELLSHIHQARTGTDMQGLALVKFSPASSDQAKLLRVLTALDYLFDPNRADKIKAPEPDSTAKEDVLQTLYESSTFGPLWTKLSECLTVIRQKENMLNVATILLPLIEALMVVCKNTTLKDTSIARNSRELSVSTTSADAGLNMEGLFFRFTEDHRKILNELVRQNPRLMSGSFSLLVKNPKVLEFDNKRNYFTRKLHSRGAEPRHPHPPLQLSVRRDQVFLDSFKSLYFKTADELKYGKLNVRFHGEEGVDAGGVTREWFQVLARGMFNPNYALFIPVAADRTTFHPNRLSGVNSEHLMFFKFIGRIIGKALYEGRVLDCHFSRAVYKCILGRSVSIKDMETLDLDYYKSLLWMLENDITDIITETFAVETDDFGEKQVIDLIENGRNIPVTQENKEEYVQRVVDYRLVKSVKDQLDNFLKGMSLSLLSSFLNSIMTTNAHYLYRLPRHHSS

SEQ ID NO: 42972 - protein, 134 aa, A.fumigatus
INLLLLLPAVFILQSTKPNDINDGLMELLIMINACKTASARRITAVIPNFPYARQDKKDKSRAPITAKLMANMLQTAGCNHVITMDLHASQIQGFFNVPVDNLYAEPSMLKWIREHLDVKNCVIVSPDAGGAKR

SEQ ID NO: 42973 - protein, 146 aa, A.fumigatus
LCLYSATGIADRLDLQFALIHKERPRPNEVSRMVLVGNVKDKIAIIVDDMADTCGTLVKAADTVMQHGAKEVNAIVVHGILSGNAIENINNSCLKRLVVTNTVPHKEKKELCDKIDTIDISPTLAEACRRTHNGESVSFLFSHAVA

SEQ ID NO: 42974 - protein, 508 aa, A.fumigatus
FPHADAPGPWRIQHVKCLKDDHNLVRSLGTTFDELVRHHPALKASIMTAIIVMVARVGLLCKSKAWAHGMGTKMWVEGPQGKPQISGNYDVLALEIGAAMDASLDDFRNLGVRELTSATLPNGGKLNLGDLTQLLPSSPEYAEPQDVDAAGLTVTDYVYPVVRFLGAFFENQANCSSFIESGAVEFVLDFATLQSLPFDFHNSDANQELTVLVHMLAETKPHLVLPSLVTRAETAVNSLSGFWSEPKDSGFFTPLIKPATEKSSEEKGKETLDIAKTNGTYFAKHMAATLVLTDLLREIFSMPLYQTRPSQHTSAFAQVNLADRYCVLVSALGSLHAACVWEEILLEKNIPATWDQATKAQAVSSDKANEGAKPPTAEGSTAESAPEGSANRGPELQGSVQQSNDTTKIPEGGAAFKNVQALRYLLSSLPSSITGFFHNLGLGLIGKRRVDSYQRQNAALVADAIAEAVLKQLQFSPPNSSDNPKHRFAYLIVILSSFSHLLYEGKLL

SEQ ID NO: 42975 - protein, 130 aa, A.fumigatus
QQMLIIFIGFHDIIPPDLISIFNEQELELLISGLPEIDVDDWKANTEYHNYSASSPQIQWFWRAVRSFDKEERAKLLQFVTGTSKVPLNGFKELEGMNGVSKFNIHRDYGNKDRLPSSHTCFNRKSSLRD

SEQ ID NO: 42976 - protein, 62 aa, A.fumigatus
SPSKAFLHNEILFLFWSQDKISARHQDPFKDIYMILSPLISSYLGLIGRYYQANGVALIYSF

SEQ ID NO: 42977 - protein, 303 aa, A.fumigatus
WFRGLFDSCFLNVVHWLGDDPCGLTFCLLLLHLLLTSSVFFLLLAFTFLFLFLSSDAFLTFTLGPLFLSSLALLFHLFFTLLLFLNCGWNKDLQQRIYDTLCLLDVSAAEQNASLLLPATSGGGQSEAYGLRRIVASSRRRSLWSAEAEDVLNTTIWQNSPPIDVDMYPVWTSYHAEARSRLSGNCLHDCVHEAYRAVHGNKASGRDRFHAMNPIGESFIAGQARLCSFCTSVGSNKKRIRAVVGTTSWDLCTVESVGLNWNYAVAIGHHSGNGSPGRLRTAESLVMSTVQWRLVAIPTPRID

SEQ ID NO: 42978 - protein, 76 aa, A.fumigatus
LEIGHNLAPHDLTNGVFVLDDMSQDQHKSALKFFVRGTRQLLNHNEEALQTSLLPKSDSYAATPSENDENSTHRKS

SEQ ID NO: 42979 - protein, 110 aa, A.fumigatus
FSKRCWAIKVIVPSSKPWYDPSSSSMPSNSSSSSSISSSSGMLSAICTIPMATRSLTIVIIQIIIDHIIMSIAETIALKILDTSRGFIQDTEQVVKTLVITATICLPNVG

SEQ ID NO: 42980 - protein, 95 aa, A.fumigatus
HGHGSGDTHDDHLQDLDDLSEGQISALYRTFFGQHGDRRKRSKRTGYIHKRIAESLLRPSYETQATSAEHCQDNGMANRAHTQRILEEHANTHAR

SEQ ID NO: 42981 - protein, 99 aa, A.fumigatus
HPTCHAMVGEIPCEVPYDRTYKIVVKVFGLLVGANYVINARRELILIEMSCHKIGRQLHGEQKRRSKASRKQAHIPRRNRVVDSLYSAQFSPIAAFSSV

SEQ ID NO: 42982 - protein, 513 aa, A.fumigatus
SNMPFSNPRCRGRGLSLSQSLRAPKSETVGMMLLWEAVHGKSASEISEMLQTWALEDQNVETALTVSHINNLIQYANSVKNPQLATDFAALLSQWKVVPDTQTRLLQLETEIIAGNERRTMELVEDLQDVGSFTLENLPLMNRLISMLCLLGKDDSLYDRVSAFLDPLFENNVRLEADTLAALTHLLLYRHDWEGISELLRPRLGSYDSEERTKIRQALTNYILDTAQDSADAWEAYGLLQVAFPETGVSMRTDIMTSFFKRKRGDLAFLVFGHMRQAEDFARRPKPDTYARCFQGIAKMQDAKNLELVHNMLKLDVEVDLNTRLLNELMLAYACCDMPDKSMEIFRDILQSQEGPSTRTIFAFFRMCEKHHHGAQEAIRMMDKVKLLEIEVDRRLYTAYVEALAAQCEFELATQAIDQMQEEIGYPPTYESYVTLPLTDPYFNAVVVATLLTVHLLGLAAFTMPFRISIGKMRSKSGPKRTTRGNGHSLRKSNAPIMKRASSLSWIADNSGL

SEQ ID NO: 42983 - protein, 60 aa, A.fumigatus
RRFSSAPSLLLTWLYETVILLLQTILKKIKEKSEEKICYSSITRNLFTQPMFPCNVNINV

SEQ ID NO: 42984 - protein, 277 aa, A.fumigatus
DLSKLSPEGYRVLVDESDVKLPSGEVVRNGMLFRNTFHLRSDQHYDIFVPCGGRPESIDLSTVGKLIQNGKSVIPYIVEGANLFITQDSKLRLERAGCILFKDASANKGGVTSSSLEVLASLSFDDKEFAENMCIREDGTVPQFYSDYVKQVQEIIKSNATLEFEAIWREHEQTGILRSVLSDRLSVAITQLDEELQKTNLWDNVELRRSVLSDALPKLLLDKIGLDTILQRVRYPPNFVTLRRETDRLWIGSGELSARYLRQLPCEPIRIQVRKQS

SEQ ID NO: 42985 - protein, 101 aa, A.fumigatus
  UNSURE (86): Identity of amino acid sequences at the above locations are unknown.
LVCLDRVFQRRRLPNRQKFLEDQKAQGESRALEKFQTRDWKAGDIYAPHDLSPAEMKKWRKRQGPAADAFDALNLNPLDLYKVRLXIRTQYSRSHSNAKSQ

SEQ ID NO: 42986 - protein, 78 aa, A.fumigatus
VANQTLFPPQNFSIMSEYMTAMGRIKHRSATGLRPVNQRKIAKAIRRAIGIGLMPSVHRHPEILAAEAKARMEGTPIY

SEQ ID NO: 42987 - protein, 442 aa, A.fumigatus
SSTTERRLSSIQVSGTSTRITYTELDSAPMARHWLALVPIERSGSTTGRLANLKVILEKESIKEVSSVCHGRRTRRSLSPPSADRTVKIWDAEAGKVCQSWTLGEEGSSNVRDQQVGVVWPSGRSDNLLISLSLSGDLNYLVEGTPEPRQVIQGHQKSITSLTQSRSEAKAETLWTGSFDGRVCSWDVSTGAAEEADGDCHSAYVAGLASTPEGTGRIYSVAWDDTLRSVDVGARTYTGSNSKLSGQPKSVAAGDSTVLVGTSEGVEIYKDGKKTGDFKPKSTVTAVAARGNVAAVGGEDSTVQICEISNSSLSPKTDIKASRNPVSALAFSPDGSLLAIGDSRGRVLVYQVADGRLVTDRWTAHTARITSIAWNESGTLLASGSLDTNLFVWSLANQGDWLQVSNAHKEGVNGVAWLADGSRIASVGADAAVKIWKVEGLE

SEQ ID NO: 42988 - protein, 467 aa, A.fumigatus
LFYSMQLRQATFVLPKTGQRLRGLVNLRSSHIATSNDDEERRGLLSGEVSTNRQDVLSPVWSRFSDVWHWTRDFVTSEPGIGVLKCSLAYLLGSLATFIPVVAAFLGHQDGKHVVATVTVYFHPARTQGSMYKALICALLAFLYAAFISLTSMCVSMFFQDTLGMRAVGHAVVLTVFCGGGLGFIGWTKQRFGDPLVNVACSLASLASITVLTKEGAVQSGDLSFTKVVQVLKMVIMGVTATMAVSFSIFPVSARKKLRSNLAIVTETLAIMLVLITDSFLSGSEEELQTTEFLNAAESHKKAYSQLDKLVREAKLEHYVAGTEKEYRLEKNLVRWVQDITHNMGGLRSAASLQFQLLKQAKLAEPQSCRDRKHAPNSTDHLPSPTQLPSHGHNTLLESIDDIPEQRLGGEEEAAAEDDHRDSGDHSDPNPARDEGFSAEHTLQPEDLFALFISHLGPSMVCRPLCG

SEQ ID NO: 42989 - protein, 376 aa, A.fumigatus
WKDCTEQPLRGPTVGEGVTPVASISPFGLEGRQTPPTKRPEKPPAKERLSYRIWKSLGVFRREDTKFAINVGTGAALYALPAFLEPTRPFYSHWRGEWGLLSYMLVCSMTIGASNTTGYSRFLGTCLGAICAITAWYVTDGNVSGLAILGLVMATWTSYIIVVMGKGPMGRFIMLTYNLSVLYAYSLTQREGSDDQDEGGDSPIITDITLHRVAAVLSGCIWGIIITRVIWPISARKELKNGLSLLWLRMSLIWKRYPLSLLAKRESSTGFMTPREKLEIERFLSRLEALQAAARAEFELKGPFPDAAYSNILRRTRSMVDAFHAMNLEMIKNVPVSEGELALLSYTAQEREHLSARISHLLSGRFLSIHNTFAVF

SEQ ID NO: 42990 - protein, 84 aa, A.fumigatus
HMTVMASSMKLEYPLMDVLPNIEHARDRLLARIFHYRKHPQASQLTTDEDYALLYAYSKLSLVPSTTHERMGALWSCILQIDLT

SEQ ID NO: 42991 - protein, 70 aa, A.fumigatus
GYIGYSMAKKSIAVVMRGSTTATDILNDVDTIQVTTTLAGVSLPSSVTIMNGVYRSWAAVTTKSSPMSRA

SEQ ID NO: 42992 - protein, 172 aa, A.fumigatus
AYANGQQRSLAFTLKEIFKEIPFTPAPDYKVSVNSRFHVSLDRALDLYQESREKALKVIYRQKELLQIQTPEVEADLEEVSASCGHFSFSLLEFGEQLKDLLRILDELQLEAEERPNGRSWSWLKVWRWRTAQTQNTKPLDSGKLCRSGTSASYLLGPNGKIVQNNRYGGQR

SEQ ID NO: 42993 - protein, 243 aa, A.fumigatus
VHTHLEHYFHQAGLTGRCPPDWELEIRKRYAQPLASETGEFPDAESIHARMIPICYEESVVSGAGFPCAEFMAIATETFVKEVLSVVFSRTRCNGPSGTINGMMMRKYRQQLELEELAYTRGEIVKDSATGLLPVEAREARNRKPLGVRDLRLALEIGGGVLSHMPLIVDHIMGGYFEDELETDKQEQIDEVADRADNDSRPIQFTNEMEVEDDAEMLDWEGATAVDRAQLGSLLDECLSLAS

SEQ ID NO: 42994 - protein, 225 aa, A.fumigatus
LIIFGVQSGKSIFLRSIDNPSIARQYTEHKAQTTVARFSPSGFYVASGDATGLVRVWDCVGEGTTKGEYSIVNGRINDLAWDGDSQRIIAVGDGKQRYGHCITWDSGNTVGEIYGHTQQINSVSIRQQRPLRAAAAGDDKNLVFYHGAPFKFNTGIRDKHTNYIYGVGFSPDGSTLVSVGADRKIWLYDGKTGEPKGHIGEGEHKGSIFSVSWSKDSKKFVTAKR

SEQ ID NO: 42995 - protein, 102 aa, A.fumigatus
SHASLLATDISQEMIIYGNVIYTIGSILVAAATTVRSFNFMIGGRVILALGDIATQIAQYKMFSSWFPPSNGFASTLGFELAVGKVRPYLALVNIWYANASF

SEQ ID NO: 42996 - protein, 330 aa, A.fumigatus
RLVSRHRLLSCKCHNLQVLNNISDQATVYTYVDPGQTSYTYLGVPETTSLLTQGFTAKTYGARTQCQLISSKCTLQNAASSVKFNCSADFTGLISTPTLQAAFFEDESMSKNLRGKVVSNYSTGNPYYFGLASVVNLSGGKTPNSTEFVKSLHGVPTYVLGCHTTIYDIEYDRLNNTVTRFQPAASNTSVSNIWQTSISQTQDWFPFFQQAAGTAIFSDTAEEFAEKVALALSKATIALGADALGTQPALAAQDRETLLVARIPVVPLVAMVAVCLLYVVCGLVLTGIAAWSARYEVPDVEARLSIAGLVADRFEEPGLRSDAMFAEHAG

SEQ ID NO: 42997 - protein, 156 aa, A.fumigatus
PGQKTGNFAWVFWTSVFMNLFTNAATVIFWFFNRYCNVHYRGRQDTATKEVLTEKNKKFELQKMFQLHWMFWTVMAFSLFQTSTASVFSQNATELAERRFNVDSITAGWYSSLSQYAGMMVPHLWLSLFRIDSGRFLSGPMFGCLYRCPREPRQCL

SEQ ID NO: 42998 - protein, 84 aa, A.fumigatus
HIPVCVCGIGMFLSMVLVNFAETRSGTAASFGIYAIAVSLGPTSIIDSIRTTLWHQSVFGSAYALKVTMNNAYVLFISAYQITD

SEQ ID NO: 42999 - protein, 70 aa, A.fumigatus
EDTYIPRMSVLNPGPFPSPEELISLVGSKNTLLRDPLFLTVQRSEKTHSRRSLDGRRAHLRSLELYRRLD

SEQ ID NO: 43000 - protein, 277 aa, A.fumigatus
QRERSGTYSTEPGVDMRANRPEQAFQNASRMLGHYLATQQTPPHGLLVKKLYIYKAVDVEQEFYLALTFDRERYSPVILISDQGGVNIESNQDKLHRFWFNLSRGITGETMAGIQKQSCFTDKEMPTIESIIRQMIKLFEERDAILLELNPLVRTPEGSFVCLDAKFEFDNAAQFRQPEVFSKEERMPGFEDEYEAQMHGLVYIRLNGHIGNIVNGAGLAMATNDLINLHGGKCANFLDIGGKATTETLLKAFEILSRDQQVRGIFVNIFGGMCTPT

SEQ ID NO: 43001 - protein, 300 aa, A.fumigatus
FSARYCQLPQRPGLLHRPPPSPRCEINAELLPQSSQDTTLTALAQLGALRLNARRCMISLFDRHTQYILAESTRTLSLQDDRVHVDGDGLWLGSSVIPKEDGICHYCCEEDQLNAGPTGPNGGYTALVIPDMTKDDRCSKRQYVVNAPHLRFYAGVPIMSRRGIAIGAFAVSDGQPRAGLDPLEIRFMTDTAAAVMNHLEMMRSHEQNRRGANMIAGLGSFVEGATLPSSSLRRPVHPHDEEEDQESENSQNIIPQTRRHHPTLADGRPPLKERGQHGEAAALPSGTAICPADSVEQKHL

SEQ ID NO: 43002 - protein, 676 aa, A.fumigatus
HERLSLKGKKQTLIKVFPAARSVTMFPLWDSRRNRWFSGLFVWTAAPRVFSLTGELAYLYAFSNSIMAEIHRLDIELANKAHATLVGSISHELRSPLHGILGSTELLTDSTMKPAQVALVNTIEHCGRSLLDIINNMLDFAKINQFTRKSRSSRFKSTHALRRRPGLPAGIAFKDKPGLGVVNLISDVQLDAVLEEVVDSVFAGHCFSAKGGLVARPASQAPARDRDGHLIMKGATERPLSAFNEALTIIYDVEPGVQWLFETQAGSWRRILMNLFGNALKYTQSGYISVTLRCSSTPSNAKMKRLARGDGTREGMGSVTLTVRDTGQGIDKQYLQSNVFKPFSQEDPLSPGSGLGLSIVHQTVVSLGGKVDITSTKGIGTEVTVTLDLPRTPQAEVAENERDASIIRKAKDRVRGKSIGLIGFESSSAEEDEALVLLRSSLLRMYKEHFGMEVGLVPSNVSDQQVYDIYLVRQSNLDEVDQICRQVTMAESDSRSPPMIVICSTPQMVQKLSTTASQRPSTSIYEFISQPCGPSKMANSLLTCLKRQRERPSCMSAGGLDTAFLNAACASKPRRHSENVSRVDFSLMPEKAIVSVTTTNVDDSAMEVTTIEATKRVPSVLLVDDNDVNLKLLVAFMKKAKFPYYTASNGLEALEVYKANAGYIPVVLMGEWSYHC

SEQ ID NO: 43003 - protein, 82 aa, A.fumigatus
DVEISEFCTSGRNPSPEIAMAQEREFYKYVSRIYELKRVRSSNSVPDIASCPSVRVSFIGPHLPLGVKSMRNCFHNHRKTPH

SEQ ID NO: 43004 - protein, 132 aa, A.fumigatus
RQWKSRFASSKKETRDLADTSSLSSATLETQKLEEIDLKNLCRRGKHSAGGKFAQNIKVNLSQDSTYSLFWSQSSIQIWDVSTCPPTFKDAITPDGFFILAAVTGTHVAYMTGDRDRKQTVSSPPPWCGDRS

SEQ ID NO: 43005 - protein, 289 aa, A.fumigatus
FICMWQLWIQSLERMTTRPVEYRVGPTPWCTSMTVSPSGSFVAVGFDKSTVGLFAPSEWQQPRLYRVHARYHQDCKDCPPIATVSFSHDGLALVCSTRSERNGMIQVFLSHFPFSEFQEVLPCRYRVPLRESEDNGISSVLFQPGRGGKEDIICITTWTQSGVPILVHPNGGHRTEIRVQSSASSNHKGKLGNRIQAAAFSPSGHELVLANDKGYVYRVSNLSSIPIEVRRVATSKEFTTKTESFALAYVHQTDEDLILVSWSDSSKGVGYVRKIPIMTTVRALRRRTA

SEQ ID NO: 43006 - protein, 280 aa, A.fumigatus
HFSKPITSNQETLRICLRSCAIADQLAETYSVNAKGDSKMSHATDLYPSIVCCAYKEPRYSHGSQELQYLFLNQSNRDHHPHTMHTPTPLTICTVLTALASCITTSWAQDAPAIKDSTILRSTVSCPDCPERNCYKCTLGHEKTLRASTGGRGWERFLIGFKLPAPVTDATKCTVQFPAFVRPNPFAVNVTVARALSSDWDEDTVNGENAPESGDIFTSMSLEPYENMQAIDITAACKGAQANGEFSIYVGTQSDSVELWSKDSDAPAILHVSGSVCKAS

SEQ ID NO: 43007 - protein, 1678 aa, A.fumigatus
RRVHRTVLREMIQNAADANATKVTIKFETLPSTTVPLPSSADQTTLLKHTISHHTLKRLLISNNGLPFSEKDWARLKRIADGNPDETKIGAFGVGFYSVFDDCEEPFVSSGKDAMAFYWKGNALFTRRLQLSEESNPETTFVLDYRNDTSPVPSLMQLSQFLSSSLTFVSLESIELWLDDWDLLRLVKKTAPSVNLTIPKDIETKTPQGLMKVTGITREVVQVDAAWMRVVEWNPNASVFRLDGLRDTTGSLRTFFSRLTGQSTQENPVKTEKPENIIDCGDLTTVLKASVFLHISTASIQCSVSHSLSSELERATRKPPPKRTTLAILTPSYDTDVASGASTSRSDILSSILPKKTGRVFIGFPTHQTTGLNAHISAPSVIPTVERESIDLNTRYISKWNLEMLRAAGIVCRVAWSAEMASIKSRILSKIDSSKSSKIRKGDIVGVLPEAIYTANQFVFRESTPSSVLGQTIEDAFWTCNKNASIEVLSTCGIIQSHQARIAPKDLSFMDSIPVLPDELVSGAKDFVRKLTDFGLVSEVTVSDIKRELEASTLRPGQVIEFLGWLSRKATSGQLDSFSIQSLLSVAVANDEDSSGNPSRLLVFGDINNFLNPQRIPVDLPVPSSVIPFKYSKSLSKQELEALGWTELQTVPWIRWLVINASNRDVLPLEQDITQSPSFSAQVLPVLSKQWDNSLSQSSKQTIISLLQSQTVIPTKLGMKRPAETYFSSVRLFDDLPVVHGLNSVKEKFLMALGVRKTVELGVIFERLLDNPQASDGKSDNQRKWSHVDLIRYLASVRDDIPANDIKRLKDTSICTAEATEHSKPAGGKRYKISELFEPKGSLRDLGLPILEWPGKYQPSSNEGKFLTMLGLRSFPSAPEMVNVMAKAAAADDWDLHGKAMSYYISEYHTNGYATFDCSAVNVPFLPIEGARDLSTPNRCFTDEGATLFGFKILRRDLHPHASKFGVKQHAAMTNCLDYMIRHPPSTKRDARVLFKYLAGRVAELSARDIERTGNAKIVPIAIRDTVEQGSVVRRVAPKLCYLGEGEDYRDIFDFVDFGQEANLFLMAVGSKREPTKTELAYMLVKEPARISASFQSADKYLKLLRSLAEHLAVLRRDKELFTEMKRSAFLLASRDITSLAQGGAKSEDLLGSDDDEVEDQSIKEWTLTAATDAVVVDDFQSFNLFKEHILAAPQEELLENFYTALGAIPLSGLVEERANWGAVAHDQRPAAKLHKLINERSRLFLHDQSPDSIRHDVRWLEKNLQVQVVNSISLTRSLKGRRVSHTQKRSAIITQNGRTWILWICPGKYDLYEISQALVHLILVRPKLHSTLTLEMLLKTDLLELKARGYNVERILKQKAQEAKIAEDRRQKQLEEERQRLEEREAAWAKEQAQLQAQEREMEAKSQPLMPGDFPDSPNNKGSNPNVEAEATETLQERRPRGLFANLTKRFGLEGGRSSWNPLGGQPSPPQPGGTPEHTGTPPPPYSADDPQRPRPEEPAPVHPPHRLQNELLSAIQACRPHGSSSLYSRPETNEVTETKSYCDEKPSHDLEFVATLPCGINVLFVKTLADRSAFLSKNSAGINLFAALLIECASVFSLRKDSLSVFYDPGGKTIAFNRAGSIFCNYFYFQQLHEKELLQNQSADRSESMVYWWVILCHELAHNLVGDHSSAHSYYR

SEQ ID NO: 43008 - protein, 60 aa, A.fumigatus
PSPWPPHKKTSLQSSASCKLTPPLPAIYRKRHSLLNNKLSTPSMAKGLLTQLQTLPAAAQ

SEQ ID NO: 43009 - protein, 184 aa, A.fumigatus
HYEKQSVLLYFAESPFFDATSNNASLAIQANYNEAFRHFVETREAFEGRLRTMQGLEFVVAYDPLQAAAQTDTQFAHEPSNVWVIRKQMRRKRAGQEDEVVVLATFFVVGDCIYMAPSVASVVGNRIVRRRWFCFAHVRKGMADQLASALCCHIANQSFENRLDAANLHPGPWAYLSTTSSETR

SEQ ID NO: 43010 - protein, 834 aa, A.fumigatus
VPSELAGHSNMAPFIGDDERASGSGQPSDSSVDAPARRNVLYIDAYDSFSYNVVAMLEEVLDVRVSVMTIDSDWPDGNMVEYLQHFEAVVLGPGPGDPNVAKDVGIMRDVWTLSGADMLPVFGICLGFQSLCLHQGIPIGRLPYPLHGQVHRIKTVNRDIFENVQDVEVTLYHSLYARLDSPEQSTRGVDSGNPQADRFASKDLDLLAWFLLEDGETQIPMAVRHQKRPIWGVQFHPESCKSDREACVKLLRRWWDMALNYNKKTGRGGYGILLNSNHCASGSITLPDAASTMLDWSTSTSSCSSYRTFTARNLDAEVVCENLNAPNSPTVLFQSNGRYSIISVPSPNSWRLEYYCETQSLLLEKLQDRRGTEIGPTRQSVAESIVERSLTVSQFWDVLRFVTDTKKVDSGSLTVPFWGGFLGYFSYEMGLACLARPKTAAGIHTTCENENAGEDPADASLLWTERSIVVDHKTGQITFQSTRVDDDLPRGWLHQAVQFLQDLAITRSQCKVYTSDTTAEFLDSILKRSVIKFPTQENYQRQIRACQAELEAGESYELCLTGETLITLPSPVSQSGRASFPWELYKRLRKYNPAAFSGFARLGHVKIASSSPECFLNWDRDSTLEMKPMKGTVRKTEDMTMEKAREILGSTKEMAENLMIADLIRHDLYGICGSGGVHVEKLLEVEDHGRVYQMITHVKAKVDRSRPGFAARDMPQLPSSNMSGYGLTALQRCLPPGSMTGAPKERSCMHLSSIEDRKRGIYSGVMGFLDLGGGGSFSVLIRTAFTCSNEQDDEQLWRIGAGGAVTTLSTPEGEWDEMLTKLRTVCGIFAPLNP

SEQ ID NO: 43011 - protein, 265 aa, A.fumigatus
ANPSPPRHLPKTPFPPKQQALHPIHGERLINTVANPSSCGSVAGNDPIHMETARALAHEFHKNNVQLVYGGGTKGLMGELARTLVSLSGPQAVHGVIPRALVRVEPGYDNKREEEKPTASSGKSAERTIKEPLDKTALLGESEYGITTIVPDMHTRKRLMAEKVMAGGPGSGFVSLAGGFGTIEEVMEMTTWNQLGIHHLGIVLLNVHGYWDGLLSWVQSAVKEGYIGADNGKILVEAKDPREVLPKLLEYRVSNGRMDLDWGQE

SEQ ID NO: 43012 - protein, 119 aa, A.fumigatus
VLAIGFLLVILSSALWHNFLPLIVVARYVIAPVPNWICARCANPDDFMDSSGNAVADFGRFLTGFLVLMGVGKFVQSNAILLPLSHLHLVGYPHYLFCKFLIRVVSNADESSPAGRACA

SEQ ID NO: 43013 - protein, 147 aa, A.fumigatus
RETPQTKHGKEFSFIAAWLIFSRPFEDGETKVSKGTFRLKQLRNLISLSTCWLRVFCCFGGANASILKSFDVIRRDVIANRSKITYEINVTPLSLIVALAIGSLGVIEEPLKNDAKLDSFTNAKRHEELFLNTIEAMDNWEVVKQPH

SEQ ID NO: 43014 - protein, 1094 aa, A.fumigatus
VPPVCYPVADKSSKAIQSSALEVGQSTPGNRIISLQNLANLLPDLANNILHLYDRASNITDEPVPQLVFSETVIRLSRLLVAARIRDGALDDNALKHIVMNEPLLPLHRPERPRGLIILRQSEIANFLFRALPLSPSSGLPATDTIPIIIGVVSVLNALDLPRKKAFILREFLSIIVPTLVQARKIGAAEVGIHPAAGLASLSDTAFDINALDVGSGNMESSMRALLGLIGEIYGVQPSPFYEWEKKRSSTASGTDPIPEYDSIAAIIERSFRHVALDRYGDLNLKIDALKACINCCEALPDFTGVLQFTVELLQTIRGDLMLAENYYQPPFLPQDEQVRLLNNIKRTVSAAHKLGASDLEAEYWDDFLVRDVRLLALPDSKRPVRRSKSHLEVVSGNGDKPSKDPFLYNPFSKTSSKISESLMIAGEHAAFTVTLQNPYEFEIEIERIRLHGEGVPLDAVTEWITLPPLCLQEVTVIGTAPTEGTVNITGCIVKVRYCRERKFPIFKDLWKPEIEMKFKRTGLAAKRPLTDRPLSWSSTTSKDGKQQPKKGPQTTSCEIKVIGQQPDLVIESMSLSQSAVMVLEGETQSFDITLRNASSCPLDFITFTFHDSTTRQIQSALTNKDLLPVEVYELELQLSMKPGLRWRRQGSSPDNLVIDAGQSATFSLDIVGKPGLQETTVQIDYSYIGLSNGQLPEEFYTRQLFVPLTVTVNASIEVARCDILPFSSDFAWRNSQESELDSVGNSSTDGDPFAPVLSQLGRGAYGHDHCILLLDLRNAWPNPLSVTLQVSEQPIEESSAEEFTPKVGQYTLTGELQPGQISRFVLVLPCVYVDNPHAPIPVLNTGIKRQFVVSANKLTFEAEAASREAFWFREELLKRLSGVWKESTTTSGHKGVIELRGIRMNARMVDAFRLDAMDISFSLSPPFPKQKASSAESIDEVMQIGRSKYKVQTDEMLDLTVTVRNRSSKPIHPLLRLQPSLRHQPSNVALDLSKRLAWTGMLQQVLPILPSGESTSVTIGVTIFCHGEYEVGASVEEVRTLRSTVGLEKDHKPAYDAPVLHDDEAIRDSFGLDATRRRRIWHARETCIMHATD

SEQ ID NO: 43015 - protein, 114 aa, A.fumigatus
QPIDWDSSPQGRIFQVEYAQEAVKQGSVVVGLVNKTHAVLVGLKVRTDFRFTCFHSQGAADMLNVYFLQPLAKRRRTIILSEEDHRSRLPYGHCYRRSGIGRSCALKLHEATVP

SEQ ID NO: 43016 - protein, 340 aa, A.fumigatus
LIFLLDMFSPLAFPTGMIIYDLTFSVPPISHLELFPFEIFREPLVVIAIADGAELPEENEESEADSATRSGDRMQPGLDELLDGLRLLKEKNTRALVHQLLIFDREGVSKLSSGPDGIIWIPRPEASKATTIKTALCDITSILLSELDEFAKTIQSVPFIESPKASSWGPHRGPDLRTRPADKLIHRMTLPTHLPSHPNDAPETSLASNKSSPGPSEHETPTTFDEITRSIQLANRASTFGKPNSLPTSKEHSRDRMSVSGMSATDRTKNRIKGRTGVVIGTLFLQTGRWPDALKELVEAATNARASSDYVWHAKALESILLCLLMFAWAGMDFQVCSIP

SEQ ID NO: 43017 - protein, 212 aa, A.fumigatus
RNAEELSSYQKKIIEVDSHMGIAIAGLASDARVLSNYMKQQCLSSRMTYGRPLPVDRIVTQIGDRAQTNTQQYGKRPYGVGLLVAGVDEAGPHLFEFQPSGMTQEMLACAIGARSQMARTYLERNLDKFADCSREELISHGLRALKETLSHDKELTVDNTSVGVVGLAGEGAQGKIETFKLYDGQSISPLLEALEQTDSGETKEEESMEVDS

SEQ ID NO: 43018 - protein, 393 aa, A.fumigatus
TTPSLPVMVQKRASQGSRRPSVTSVSSSTPITPSFTTSVITTTDKHYPHQQQHRDARHTRATSWTSGHDQGGEPSFADYHSSASHSRRRRESNLSLADLTEGSSPSSSLSFDHPNMAMKTTSSEWNPGHARSRSQSMAQMNASQAHSISDPAPRPGPVTWMSLPRKKQLALLGLCRVFDFLQIASLQAYMFYQLKSFDETLSDSDVSTQAGILQGAFTAAQFATAIPWGRVADAEWGGRKFVLLVGLVGTAVSCLGVAFSTSFAQAVFWRSFGGAINGTVGIIRTMIAENVKEKKYHSRAFLILPIGFNIAALFGPGKVLCFHCSCLRFDTDHYSHGRYACRSRQELPPAVRPQFFLWRCFRCPVAHEIPLCVAHAGQRRFPVTLRYVCRSGP

SEQ ID NO: 43019 - protein, 192 aa, A.fumigatus
LAPLLTIASAFNNLWLLFLSTPRYDSSDPASPVQRLPFIFTGGLGMLPQSVGFATAILGIIGMLLQFTVYPSINGRLGTAKSYQYFLSLFPLAYAFAPYIALAPSSTPPPGQANGPWVWFSIIVVLFLQVSARTFTLPTSIILLNNCSPHPSVLGTIHGIGQSVSSAFRTIGPIFSGAWYGYGLEIGMVGFA

SEQ ID NO: 43020 - protein, 62 aa, A.fumigatus
LDHLHDLDGDVGCDDILDADAGGGLTAFVQERGKFAALDDGRGGVLSLEKAEARNEEAEGGG

SEQ ID NO: 43021 - protein, 182 aa, A.fumigatus
NSNVFIMPSRKLTWLITGCSSGFGLSLTRTALAGGHRVIATSRNPSRTPELVAEIESRGGRWVQLDVDSAQSGDVITELERGGEQIDVLVNNAGYSIYAPIETITEEEMRSQMETMYFGPLRLIRAVLPHMRQRRSGVIVNMSSGASLDGIPTMGVYAGAKAGLDGMHLFLKTVPKGNQLTA

SEQ ID NO: 43022 - protein, 178 aa, A.fumigatus
APLTDLSYVSDLPVLFPYPRIYPEQYAYMCDLKKTLDAGGHCVLEMPSGTGKTVSLLSLIIAYQQHYPEHRKLIYCSRTMSEIEKALAELKELMKFRSQQLGYTEDFRALGLTSRKNLCLHPSVKREKSGTVVDARCRSLTAGFVKEKKERGEDVELCIYHEVCADVLRKLWVEPLTF

SEQ ID NO: 43023 - protein, 72 aa, A.fumigatus
NLDLLEPHNLVPPGVFTLDGLLKYGEEHKQCPYFSARRMVIYCLKSLSVCANTGSDALLQRHYLFLSLPPRS

SEQ ID NO: 43024 - protein, 151 aa, A.fumigatus
FYPLGLISLLCLALVKFFAFIALACDLTLTITVMGGMLADPVKSYPRLFGPNSSFGGASGVQWLMKFPYALPMLANAVFLSLCATCVAVGLEEVWSLYPEDVRILLTQPDFTSLQGKAWPGRFRHEALRPWVEGCRSVVVTSIFQTSILRL

SEQ ID NO: 43025 - protein, 608 aa, A.fumigatus
SPCRCVLTQVQMPYCNVIIYSYHYLLDPKIAERVSRELSKDCIVVFDEAHNIDNVCIEALSIDITEDSLRKATRGANNLERKISEMKSSDAEKLQNEYSKLVEGLREAEQARDEDQFIANPVLPDDLLKEAVPGNIRRAEHFVAFLKRFIEYLKTRMKVTHTISETPPSFLTHVKDLTFIERKPLRFCAERLTSLVRTLELINIEDYQPLQEVATFATLVSTYDKGFLLILEPFESETATVPNPVLHFTCLDAAIAIKPVFDRFSSVIITSGTLSPLEMYPKMLGFPTVLQESYTMTLARRSFLPMIVTRGSDQAQISSSFQIRNDPGVVRNYGNIVLEFSRITPDGIVVFFPSYLYMESIISMWQGMGILDSIWNYKLILVETPDAQESSLALETYRTACCNGRGAILFCVARGKVSEGIDFDHHYGRAVLCIGVPFQYTESRILKARLEFLRENYRIRENDFLSFDAMRHAAQCLGRVLRGKDDYGIMVLADRRFQKKRNQLPKWISQAMLESETNLSTDMAVATAKNFLRTMAQPFKAKDQEGISTWSLADIERHREKQMLEEERVRREAVANGRATNGTHNGASAAADEFDDDIDEDLMMLDAQ

SEQ ID NO: 43026 - protein, 165 aa, A.fumigatus
SRMASRLTPSVMTCAGSPLTGSASTYVQLPRPGIDWMTALRAASSTRGRRRSLGVEMSYCSCTTHDVPLLGLNLNCVTSPYLPLMSSSRNLVSFVSSSVSSSESSMSTSESWRRSSPLSSSSSSSSTASCCRTMSISSCSGPSYETWFDRFWPRLHPQGLATIRA

SEQ ID NO: 43027 - protein, 135 aa, A.fumigatus
PNQTSQACKGKPGLGAFAMRLFARGLKAVVPSSSPLYSRLPFSDYDEEGPLLSRPNDPTESYELEEKAAKPTRHARVLPFRRIWTKNVLCTLLAQAFFDFQMGYVSLSPDIARTFVDDCQCLQQSMVAFPIHPSL

SEQ ID NO: 43028 - protein, 140 aa, A.fumigatus
TPCPSARRACRAAWSARARHAGSAATRRRSRRRLRRALRQCSSGSAPRRSRRRLPPPRSCGLGPAYFPRCLVSASSTHPLPKMKTPGMTWTRYPHLQMTRPEGECDRARASALPSPLSGPPWRDSARGRPSPRTQADRGH

SEQ ID NO: 43029 - protein, 150 aa, A.fumigatus
GWFGWYASLSQNSSKGQSANRIALTKILAKEVAPFNIRTLTVVLGTFNTNMINSIVLGKTPLPEDYKGTFTGQVQGLLLNGKIKPNGDKDAAMQAVYQVVVGEGVGEGHEAEKLLPLGSDMTPRLKGVQDYLGHALEVFGSVTNSVDVDK

SEQ ID NO: 43030 - protein, 286 aa, A.fumigatus
RRGQNRSNQVSYEGPEQEEIDMVRQQDAVEDDEDEDESGEDRRQDSDVDMDDSDEETDEETKDTKLREEDIKGKYGEVTQFKFNPSKGTSCVVQLQYDISTPKLLLLPLVEEAARSAVIQSIPGLGNCTYVEADPVKGEPAHVITEGVNLLAMRDYQDIIKPHSIYTNSIHHMLMLYGVEAARASIVREMSDVFQGHSISVDNRHLNLIGDVMTQSGGFRAFNRNGLVKDSSSPLAKMSFETTVGFLKDAVIERDFDNLKSPSSRIVAGRSGMVGTGAFDVLAPVA

SEQ ID NO: 43031 - protein, 182 aa, A.fumigatus
SSMLISSSVRTSEVRRSAQNRRGFRSMKVRSLTCVKNDGGVSDIVWVTFIRVLRYSMKRLRKATKCSARRILPGTASLSKSSGRTGFAMNWSSSLACSASLKPSTSFEYSFCSFSASELFISEIFRSKLFAPRVAFRNESSVISMLSASIHTLSMLCASSNTTMQSLESSRDTLSAILGSRR

SEQ ID NO: 43032 - protein, 142 aa, A.fumigatus
SITPLPHITMSKKFKSQASSSRAAAGAYGSFGGFSSAFSSAGRAPSSLTYVTAPPDLSRIADAKLAISFKNFLKKDEVTRIKALDEIKDYVLTVESRDATLDDGFLDAWVCLQAYLADRNLMLIVFRRSRFIHGPRLTFPVG

SEQ ID NO: 43033 - protein, 255 aa, A.fumigatus
IGITGTYVRTTAIDRLVARFLEGPSQTKKQIISLGAGSDTRVFRLLSSRSSASSSDLIYHEIDFSANTAAKIKFIRAAPLLQRTLGLGSAQNVAIPDSGDALHSPTYHLHPVDLRTLAASGSATTSRSPSSPNPAEKDQPPCPLQGVDPTLPTLLISECCLVYLSPREAADVVDYFTKTLFPASVPLGLIIYEPIRPDDAFGRTMVANLATRGIQLQTLHEYASLEAQRRRLREPGLHTGQAGADIDFIWDPWVS

SEQ ID NO: 43034 - protein, 63 aa, A.fumigatus
DIDLLATPFELRDHVAALGAVNVQLHPSAPSAFNLGDQLRGARRVAGGSYDPVPAGQGGACEG

SEQ ID NO: 43035 - protein, 415 aa, A.fumigatus
EDTNTNTASKTRLTSTLRLLIPRLRLLQRKDTASSVIQRRELATLLDEGRESSARIRVENVIATDIAVEVMEMVELYCELLLARVNVLDQLAFGEKGARARSRAKEALKAEMGAQKHGHGHTHPQDASSGGGDTASKSFLGFSFWAGGGSKKQTPNISESTPGRGRKTEAEEAADENDEEQTPSYIDAALDEAAAVIFYAWPRFPHDVRELTMLRGMLAERWGKEFMTLAQDNKLVDVRVPERLVKGLRVKPPAQELVESYLREIAKAYGSSWGAQAQSQSQSESELGEAPREFVGDRPGDTDQPGDGDGDGDAAVPSTQTRPVNMAEARRASETSELNKATPPRGFQSVKSPVSVAPPGPRSDNPNPRVKVPGSEIQSETQVEEPPRARNGNAGGSGGIPELDELARRFAALRR

SEQ ID NO: 43036 - protein, 176 aa, A.fumigatus
KMMKMKTKVARTVARILTSTWTTPTKKQTRRRKTPNCARRTLRANMAKSHSSSSTPAKAHHALCSCSMTSPPPSSSSCLWSKRPLAAPSSSLSLASATARMWRRTQSRASLHMSSPRVSTCLPCAITRISSSLTPSTPTRSIICSCSTVSRPRAHLSCEKCPTFSRATVSPSTTAI

SEQ ID NO: 43037 - protein, 176 aa, A.fumigatus
EFDVDCISQIKIYPRASIDLSRRVRQTAHSAQGSIASVVGKRIAPYLPKVIGAWLAGFYDNDRPVHRAALESFMLVFTTEEKRNGVWKVYQSSILDFVDDVILQQTPQTLSDERTVKPDDAEAKYARVVGTALLLLNRVIGVYIISQNCSPVLTLFSKFNSRRPPKGSGHGRESTE

SEQ ID NO: 43038 - protein, 496 aa, A.fumigatus
MFAGSNFSTTAIVGGRLLRKDYVFQETPSIHPERLPGRRGLLLVNLRQLLQIIPVKVLAKTDPQASTCRMIGLSSATLLTEAFQLGVNSREEPRQNQALGWKSYIETGIWLTSSLPDSDRDAFLHTRLSPLVTQYVRAEQNAPQWTLPNQNAVALCTEYSVALANGNYGSEFQRLWTDLADGLLKSVKLSAPEQSKEFRSSQDAVCAQAERLFALEASVLASVADSEARASVSNILSKTNLPLLDNCLQVLRSRNGKPYAAAAVVEEMIRNAADIAQQSRELADFVQNDAPELLSSPSADRLVSVILSCRSWDGFGSSFDTVVERVAESEPEQSNTHAVQKLLSTLDFKEVHDKTGLDSLIKRALDQACRGSRFHWPIVIAALQNQTSHGELTDSIFLIIVDSLSEPTKVFEALHGLSQIAKSVPDALSKFQAGAHGSKLAGRLLFLAETSDEEVASLAESVLTEFKEIGVGETSAKSSFELLQYNFDHVNEESLS

SEQ ID NO: 43039 - protein, 473 aa, A.fumigatus
HLSRIGSLLSIAEDLLGAADPEARASIAKDILPSRQTWETALRPFLELPPRPSTAITSPLGGTVHLVNPEISDTLKEQYHTIPRDSSGCSSAFRLAYFTIRVLSSFDIMGNLSAEEQETLFHYIPLAVQLIDDDLSIENCNGITGLTHSDQREEYLEIVYDGRKVMNQWTGSDGRQSEANATVALRTLSFWQNKLEALNNTSPTDYRIGEAFVRLMNSLDSANKSKSTEDITNICREMRSANAIRSASWVAVLRESILGNPTGNRLCNELVADSTGLKPQDEKKEGRLPIGSSLGDSTDALQGLRKLSLLNLLLAGEINVASTIPTQRLVFLVKHLIQCLQSKDLPLNIQAEIMHTLTFVLPYLNEIYGSHWEDCMEALSTVWRETSGGDEALPLLLGSFRLFASLRSIVAEEDSNDDVKDAWSERKTVLFNGLASTLTKFGELECIPRIEMCNGLILSRLHHCFPSAPRCYR

SEQ ID NO: 43040 - protein, 96 aa, A.fumigatus
PLCQRGMPQHAFEYTIKQLLIFIQKSLPVQEQYVASIKDSDSLGPLLEFMFDFLQQPNNKLVDASKFDIRSFEPDQSETQEKEAPNGFWSTYTFCV

SEQ ID NO: 43041 - protein, 175 aa, A.fumigatus
SEISPLIIEDSLKGVNKWMTTQDPNEERALSVKISPKTAEIIASIPVDEESPPVALSISLPPAYPLQPALVVGRSRVLVDERKWKSWLLTIQGVIMFSNGNLVDGLMAFRKNVQGALKGQSECAICYSVISTDMQTPNKRCATCKNTFHSVCLFRWFKSSNQSTCPLCRNNFVYV

SEQ ID NO: 43042 - protein, 138 aa, A.fumigatus
GRDLGTTVVRMRFDMISGASALLWFVASVEASKHAHRHQMRNEHSAVHSVAEVGAPLEKRGGKCQFPTDAGLVAVTPNMKNAGWAMSPDQACEPGNYCPYACPPGQVSMQWDPEATSYSYPKSMVSFPLGGFIPTGRS

SEQ ID NO: 43043 - protein, 78 aa, A.fumigatus
NGGLYCDKNGQIKKPFPDKPYCQDGTGAVGAKNKCSKQVAICQTVLPGNEAMLIPTLVEDTATLAVPDLSYWCETAAQ

SEQ ID NO: 43044 - protein, 298 aa, A.fumigatus
VHPVRILLSHLVLTVVSFYINPPGYDTETACVWGTSAKPIGNWSPYVAGANTDGDGNTFVKIGWNPIYLEPTTPFRDVVPDFGIEIECEGDGCNGLPCKIDPAVNAVNEMIGSTSVGAGGATFCVVTVPKGEKANVVVFEKSGGGSGSSGGDDDSHSTTAAPSKPSSTTRTTSSSIESSSTSTSASSSSSKPTDTDSSSSSATVTPSASSDPSSSAKASSAGQASESGTFSYTYKPHVFVEQSVSVQAMADETAGPAQATATPTPASKEKEKEGSAADVAVSVLTLGMGAVAAIMINL

SEQ ID NO: 43045 - protein, 129 aa, A.fumigatus
ARGLPGRNSQFHLWGGGVIPFARGIGKDPAGFRIGGSRDPCLIRGWLGVPPRSLGEVWVAKTFPFNGPRQAPGGFEGGPRTPFSGDAGGPPGDGRSPGDLHLHGLSPVGPAEMARGDPGAPPPPGDEGQ

SEQ ID NO: 43046 - protein, 136 aa, A.fumigatus
  UNSURE (115): Identity of amino acid sequences at the above locations are unknown.
PVGGSPLGRPAAGRQGRAPWTDAGRATHSQGTGGDPFGRGPPWDRHRVEKHPDGHGKRPQVTNWAGRAPPCSARKTPRPPRGHLQRTPPWAVPPQRDSGYGPPGGFPPVGESPNXPPSLPFFFCCNLPPLLPPEVL

SEQ ID NO: 43047 - protein, 133 aa, A.fumigatus
YGVGWGFRPDPLVRFGWQKPSPSTGPGRPRGVLRGGPGHLSPETRGGHRGTAGPLGISTSMDSRQLARPRWPAGTPGRRRRLVTKGSDQLAGAHGRTGGARSAGAGGPPPGTTFGPGNVCAHDDGPGEVGGYV

SEQ ID NO: 43048 - protein, 195 aa, A.fumigatus
ARALEASRESRARGRRREGEEGEEGEARRRARGGQLAGRVGAAGGAARAGGRVTSWREPLGQAGRRQARARAMDRRWPSDTLAGTGGDQLAGARQGPTPGRETPRRTREAPEVTSWPARARPCRHRRAARRLRGHLQRHAHGRRPRRMPAWPAGGIHPWGYADTHPSIHIYMCICTRIPPRHLHGGRSAWPTGAI

SEQ ID NO: 43049 - protein, 149 aa, A.fumigatus
PASELPIHPSRYTDRHTDPAADIGRARAPCRSERWAARAEGTGGQAGAGFEGRPALRARDGASDQVPLRPKQRANLRGPLCMGARANARTTPYRMGPPPARSGPGNVCTHDHGPVEVGGSMWKARAASPLVACELCAGHFFPARQAASL

SEQ ID NO: 43050 - protein, 149 aa, A.fumigatus
WAGRGRWVCVGEGPPAARARVPVEGSRLRGAGGPVGARPRGEQRVARARATKGGRGGRGGGGAQASARRPVGWPSWRGGGRRAGGRQGDQLAGAPWAGRPPAGKGARHGQTLAERHTRRAPGVTPLAGAPPGTDTGSRNTQTDTGSAHR

SEQ ID NO: 43051 - protein, 192 aa, A.fumigatus
KRPGAHIAGMTEARGPFGPRHRWSLWIVGRWPVLIPRFPGGAAPREPPFVGVSAGSGPPTRGPYAAARQRPRGRSDGITCVRTGSEGLQWGQLDGRRRSPGAPGAVGAAGRRMSPLLDSPTYTPPLRGLVGPARSAPFARWSAGAGAHQVLGIWLILPVVICLSQRLSHACLSISNLYGETANGSLNQLSFI

SEQ ID NO: 43052 - protein, 141 aa, A.fumigatus
SDQAGRVSGQVALLLRVAERQPDPWLDLLANTSHQRARQRRALGGGPRHLSPETRGGTGDGRSPRDLHLHGLSPVGRPRWPRGPARRRRLVTKGSDQLAGAHGRTGGARSAGAGGPPPGTTFGPGNVCAHDDGPGEVGGYV

SEQ ID NO: 43053 - protein, 368 aa, A.fumigatus
  UNSURE (22): Identity of amino acid sequences at the above locations are unknown.
QNFGGEKGGQIATKKKWEGWGXVWGFPHGREPPGRAISGIPLRRNGPRGCSLQVSPRRAGGFPGRTRGGAPGPIGHLWALPVSVWVFLDPVSVPGGAPAKGVTPGALRVCRSASVCPWRAPLPAGGRPAQGAPANWSPCRPPARRPPPRQLGQPTGRRALACAPPPPRPPRPPFVALARATLCSPRGRAPTGPPAPLNRLPSTGTLARAAGGPSPTHTHRPRPAHHRARKRSRVRTSFRGEAHLRRQTARRPCGHVPQPTGHCPSSPGGGGARVPAAISAGQLARVHGGGDPEGTGRHRCPPASPEKGVWAPLQAPGAAGPVDGRCLPTNLAKDRADAQRLVATRLLDRLHDPLGHFSRLQRIHPRAR

SEQ ID NO: 43054 - protein, 359 aa, A.fumigatus
MAPVGHADLPPCRCRGGMRVHMHIYIWMDGWVSAYPHGWMPPAGHAGIRRGRRPCACRCKCPRRRRAALRCRQGRARAGQLVTSGASRVRLGVSRPGVGPWRAPANWSPPVPASVSLGQRLSMARALACRRPACPRGSRQLVTLPPARAAPPAAPTRPANWPPRARLRASPSSPSSPSLRRPRARDSLLASRARAYRAPSPPQPTPLNRDPRARRRRPFSYTYPPTSPGPSSCAQTFPGPNVVPGGGPPAPADRAPPVRPCAPANWSLPFVTRRRRRPGVPAGHLGRANWRESMEVEIPRGPAVPRWPPRVSGERCPGPPLKTPRGLPGPVEGEGFCHPNLTKGSGRNPQPTPYQTRVP

SEQ ID NO: 43055 - protein, 288 aa, A.fumigatus
GGTAQGGVRCKCPRGGRGVFRAEQGGARPAQLVTCGRFPCPSGCFSTRCRSQGGPRPKGSPPVPCECVARPASVHGARPCLPAAGLPKGLPPTGHPAARPRGAPRRANSASQLAAARSPARLPLLALLALPSSPSRARLSARLEGARLPGPQPPSTDSPQPGPSRAPPAALLLHIPTDLARPIIVRANVPGSERRSGGRPTCAGRPRAARAAMCPSQLVTALRHQAAAARGSPRPSRPANWRESMEVEIPRGPAVTGAPPRLRRKVSGPPSKRPALPGPLMGGVCQQI

SEQ ID NO: 43056 - protein, 74 aa, A.fumigatus
QQGYLTAYTTRLVTSVVCRGFIPARGDIAIRQPAPGGFSPGAVASLLRYMARRPIRIQLRRAGLHRRVPARILT

SEQ ID NO: 43057 - protein, 82 aa, A.fumigatus
SFAPIPKFDDRFARQNRCEPPPEFPLASPYSGIVHHLSGPHSYARTQIHPKTSGSVDGAPREGAPTSVRFHCAYGFDTRTLA

SEQ ID NO: 43058 - protein, 191 aa, A.fumigatus
KNKVGCRLAPAGPTEQVTKPHTLEDRTRCRRCLSGPSPGRGGRGPNTQAVLEGSNDARTGMPPGIPGGAMCVQRLDDSLNSAIHITYRISLRSSSMPEPRDPLLKVLTDYDNQLRLHTFRTAFMLGSSAGAGPGAQGLPGGRRNGGPAEATRYDRHGWEVGPRGPSLGNDPSAGSPTETLLRLLLPLNDRV

SEQ ID NO: 43059 - protein, 387 aa, A.fumigatus
LARWHRWAMPTYLRADVGGGCGCICTYIYGWMGGCLRIPTDGCRRRAMPASVEADGHVRVAASVPVDGARLSGADKGARAPANWSPLAPPVSVWVSLDPVSVPGARRPTGHPRCLRVCRSASVCPWRAPLPAGGRPAQGAPANWSPCRPPARRPPPRQLGQPTGRRALACAPPPPRPPRPPFVALARATLCSPRGRAPTGPPAPLNRLPSTGTLARAAGGPSPTHTHRPRPAHHRARKRSRVRTSFRGEAHLRRQTARRPCGHVPQPTGHCPSSPGGGGAPGSPRAISAGPTGESPWRWRSPGDRPSPGGPPASPEKGVRGPPSKPPGACRGPLKGKVFATQTSPRDRGGTPNQPRIKQGSLEPPIRNPAGSFPIPLAKGITPPPQR

SEQ ID NO: 43060 - protein, 322 aa, A.fumigatus
  UNSURE (23): Identity of amino acid sequences at the above locations are unknown.
AELRGGEGGANCNKKKMGGMGGXLGIPPREGTPRAGHIRNPVEAERPKGVFAASVPEEGGGFSGPNKGGRARPNWSPVGASRVRLGVSRPGVGPRGGPGQRGHPRCPASVSLGQRLSMARALACRRPACPRGSRQLVTLPPARAAPPAAPTRPANWPPRARLRASPSSPSSPSLRRPRARDSLLASRARAYRAPSPPQPTPLNRDPRARRRRPFSYTYPPTSPGPSSCAQTFPGPNVVPGGGPPAPADRAPPVRPCAPANWSLPFVTRRRRRAGPRGHLGRPTGESPWRWRSRGDRPSPVPPRVSGERCLGPPPSARRCRAR

SEQ ID NO: 43061 - protein, 135 aa, A.fumigatus
SQSLSRSYGSILPTSLIYIVLSTRGCSPWRPAAVMSTTWRENYSFPRIFKGRRGRTGPRKGAGLCQPWNPSSGQTDFRVEGCQEEKRTLPRTPADVSAFSYVAVENPHPGAGMLTGFPFGTRRTRAPFKRNFPMP

SEQ ID NO: 43062 - protein, 65 aa, A.fumigatus
FIRPVSCYTLLSGFRLPWPPSGCLDELTPFVVSDERAFRHLNLAFGSSRIASSAYQKWPTSNASF

SEQ ID NO: 43063 - protein, 267 aa, A.fumigatus
TARGSPVPTRARARRPTGHLWRLPCPSGCLSTRCRSLARAGQLVTPGACECVARPASVHGARPCLPAAGLPKGLPPTGHPAARPRGAPRRANSASQLAAARSPARLPLLALLALPSSPSRARLSARLEGARLPGPQPPSTDSPQPGPSRAPPAALLLHIPTDLARPIIVRANVPGSERRSGGRPTCAGRPRAARAAMCPSQLVTALRHQAAAAPRGPRGPSRPGQLARVHGGGDPQGTGRPPVAPPRLRRKVSGAPPQNPPGPAGAR

SEQ ID NO: 43064 - protein, 64 aa, A.fumigatus
RGRFLPPKPHQGIGAEPPTNPVSNKGPLNRLSETPLGPFQSLLQKESLPRPKGEIVNSGQASPA

SEQ ID NO: 43065 - protein, 178 aa, A.fumigatus
NYERLKNFFFMNNIFLLNDYITNGFRIEFVDMIYLISILFGVLTIVSRNPIVSVLFLIGLFVNIAGLLILVGYNYIGLSYILVYVGAVSILFLFILMLINIRISELLSETNNDIPLAVLTVLLFYYIVGQVLPSNLTDNTIVSYLSNSFSEVYNVQLDNEFFNIVDLKQEIAYASSKG

SEQ ID NO: 43066 - protein, 104 aa, A.fumigatus
LIVCRMYVVCNSILVKVTLLKGLNTNIYSKMLQAAKIIGTGLATTGLIGAGVGIGVVFGALILGVARNPSLRGQLFSYAILGFAFAEATGLFALMMAFLLLYVA

SEQ ID NO: 43067 - protein, 83 aa, A.fumigatus
YIFRCRWFINIFCIINNYNNAYSNIIKLKFNTITKCIVICSNNVIIRNIIISSILSIRCIVILYILRKYFTTIIFINRIIWFK

SEQ ID NO: 43068 - protein, 60 aa, A.fumigatus
FCINITFYLNILNEFHCCFRCNILRIPKTWIKILFIICTFRLSFSIITFISFNRIHFILI

SEQ ID NO: 43069 - protein, 103 aa, A.fumigatus
PPLGIQGVNPFELPLLNTIILLSSGVTITYAHHSLIQGNRKGALYGTVATIILAIIFTFFQGVEYTVSSFTISDSVYGSCFYFGTGFHGLHVIIGTAFLAVGL

SEQ ID NO: 43070 - protein, 333 aa, A.fumigatus
KIEKQLRKERLRHRLRKLSTNRIFVSDGEFKHTNDKVNITLYVYNRQKLNYLLKLKKRYIRLFKRVKFVRKLQLIRNIGLNILKKQQEKSKILTNILPNYSSKISRIQNFYYKKFIIKSFKRLKYYMFYKQLLYINKAKFENSYLQGLINLIKKIYKKNVEFNIINLKYFYFNSDIFTQPLVLKLRKKRKPLKYLKALVRKAKIKKIKLNERSKYFFELNNLFTVNNLDTTNNLLNNLIEENKTSSKYLKKIVLNNIKYKRVSGVRIEAAGRLTRRYTASRSQHKVRYKGNLVNAYSSIKGYPSSVIRGNYKPNLQYTKLNSKSRIGSFGVKG

SEQ ID NO: 43071 - protein, 207 aa, A.fumigatus
YLSSNAKDIGTLYLIFALFSGLLGTAFSVLIRLELSGPGVQYISDNQLYNSIITAHAIMMIFFMVMPALIGGFGNFLLPLLVGGPDMAKEKKEMDLHRFNIRYYSNDLKNKFKGYLAGLFEGNGHISIKKSSKKKHNPRFYITFNMKNQPLAKKLVDLIKWGDLRYELKNDACVLVVSSVIGLKKVVELLNGELRTPKIHLLYNLID

SEQ ID NO: 43072 - protein, 106 aa, A.fumigatus
LSGFIDSNGSFSIQHTKLKNGIKKRKISCRLRIEERILDPITKNSYLKVFTDISNFLNCSLLTRKQKSTGNEYYILTVSSIMSLNLIVNYLEKYPLFSSKYLDYKD

SEQ ID NO: 43073 - protein, 62 aa, A.fumigatus
FLLVMTFNIFILINILFSKKKNYFYIYILLFLIFFFYIIYEFIFAKKIYIFFIILLKISNLF

SEQ ID NO: 43074 - protein, 149 aa, A.fumigatus
IIIYLFNNSSSQLIKQKQICLYIMTTTTFFLFLIPVLAIILLAVNLILSPHNPYQEKDSAFECGFHSFLGQNRTQFSISFFIFALLFLLFDLEILLVYPYVVSAYTNGIYGLVIMLVFFLVLTLGFAFELGKNALKIESRQVFNFNYKS

SEQ ID NO: 43075 - protein, 120 aa, A.fumigatus
SYQYPDFTNEDNEFIEFDSYIVPESDLEDGQFRMLEVDNRVIIPELTHTRFVISAADVIHSYACPSLGIKADAYPGRLNQASVYVNRPGTFFGQCSEICGILHSSMPIAIQSVSIKDFLL

SEQ ID NO: 43076 - protein, 64 aa, A.fumigatus
IMYLTLIILPLLGSIISGFFGRKVGVRGAHIITCTSVITTTFLAILAFFEVGFNNIPVTINVAR

SEQ ID NO: 43077 - protein, 65 aa, A.fumigatus
NFRFDSLTVSMLLPVLIVSSLVHVYSISYMSHDPHNQRFFSYLSLFTFMMIILVTGNNYLIMFVG

SEQ ID NO: 43078 - protein, 381 aa, A.fumigatus
LGAITTVFSSLIGLFQQDIKKVIAYSTMSQLGMMVIAVGLSSYNLALFHLVNHAFYKALLFLGAGSVIHAVADNQDFRKYGGLREFLPLTYSVMLIASLSLVAVPFMTGFYSKDFILESAYGQYYLSSTIVYFVATIGAMFTTLYSAKVLYLTFLANPNGPLVNYKHAHEGDLFMTIPLIILAIFSIFFGYLTKDIFIGLGTGFFTDNSLFIHPSHEIMLDTEFAVPTFFKLLPFVFTVSLSILSVLLSEFLPKLLINFKFSRLGYNIFSFFNQRFYIELFYNKYIVEGVLKLGGQTSKSLDKGSVELIGPYGLEKGLLALSNSIGNLSTGVVTTYALYILIGLIFYISLIYFSYNDNNLLILVIFTLFALLNSNNNKLSS

SEQ ID NO: 43079 - protein, 107 aa, A.fumigatus
GGFSVNNATLNRFFALHFLLPFVLAALVIMHLIAMHDTVGSGNPLGISGNYDRLPFAPYFVFKDLVTVFIFFIVLSVFVFFMPNALGDSENYVMANPMQTPPAIVPE

SEQ ID NO: 43080 - protein, 111 aa, A.fumigatus
YLLPFYAILRSIPNKLLGVIAMFAAILALMVMPITDLSKLRGVQFRPLSKIAFYIFVANFLVLMQLGAKHVETPFIEFGQISTVLYFAHFFVIVPVVSIIENSLVELATKK

SEQ ID NO: 43081 - protein, 71 aa, A.fumigatus
AEYASIVLICVLNSILFLGGYLSIIPLDFIIYILNLFFNVNDTILYDIFIHISSSPLNLAFKTAFLIFVFI

SEQ ID NO: 43082 - protein, 108 aa, A.fumigatus
IKYKIINMSLLLLLIPLIGIGLVTIEANYGLSLINNIRIKSIALITSIVNLVVSLIMFILFDFSSKQFQFIEEHYQISYFDIYLGVDGLSIYFVLLTTIIMPIAILSN

SEQ ID NO: 43083 - protein, 126 aa, A.fumigatus
NSIQSQNVLSFVVIMLLLETLLLAVFLVLDVLLFYIFFESILPPLFLLIGLFGSSNKVRASFYLFLYTLLGSLFMLLSIIAMSSIMGTTDFDALSKANFSYVTQLFLFYGIFIAFAVKTPVIFLNT

SEQ ID NO: 43084 - protein, 259 aa, A.fumigatus
LLKAHVESPLSGSIILAGIVLKLSLYGIFRLMLPLLPKASLNYTYIIYVIGVITIIYASFSTLRTIDIKELIAYSSVSHAAVYLIGAFSNTIQGIEGSILLGLAHGFVSSGLFICAGGVLYDRSSTRLITYYRGMAQVMPIFSVLFFILGLGNSGTPLTLNFLGEFMSLYGVFERMPILGVLASTSIVFSAAYTIFMYNRIVFGGSYSIYFVENIGDVTRREFIMLLVFVILTVLFGIYPAPILDGLHYSVSSLIYSIN

SEQ ID NO: 43085 - protein, 69 aa, A.fumigatus
HRIVMRHLDFVLSPLDQFEVRDLFSLNANLFGNIHLSLTNIGLYLSIGLFLILTYSLLATNNNKIIPNN

SEQ ID NO: 43086 - protein, 191 aa, A.fumigatus
SISQESMYATVHSIVVSQLNPTKGQLYFPFIYALFIFILANNLIGLVPYSFASTSHFILTFSMSFTVVLGATFLGFQRHGLKFFSLFVPSGCPLALLPLLVLIEFISYLSRNVSLGLRLAANILSGHMLLSILSGFTYNIMTSGVLFFFLGLIPLAFIIAFSGLELAIAFIQAQVFVVLTCSYVKDGLDLH

SEQ ID NO: 43087 - protein, 69 aa, A.fumigatus
LATCYGGSLHLTPPMLFALGFVVLFTIGGLSGVVLANASLDVAFHDTYYVVAHFHYVLSMGAVFALFSG

SEQ ID NO: 43088 - protein, 98 aa, A.fumigatus
INQNKNYYTMNFSIFLFLIGILGFVLNRKNIILMLISIEIMLLSITFLILISSLSFDDILGQTFAIYIITIAGAESAIGLGILVAYYRLRGSISIQYK

SEQ ID NO: 43089 - protein, 264 aa, A.fumigatus
FKFILEYYMLLSSIFCLLLSNALSFRRDTTILYSRIGIIALFYCIYLSYNNLFITYLDNGIGLFGGLFYTSSITQVFHILIFIISLLILNMTGFYPRKLISNEYMSLYKLLFTKLQFIKNLTVSNIILKKGEQYTILEYTLMLFFIITGSVLLISSSDLVSIFLSIELQSYGLYLLCAMYRNSESSTSASLTYFLLGGLSSCFILLGIALIYANLGVTYLDSFYLINNLAGIVDEQEITTYIPYCLLLISVGFLFKISAAPFHF

SEQ ID NO: 43090 - protein, 241 aa, A.fumigatus
TTSLLVSSLLSLIIGTILGLTQFRIKRLFAYSTISHLGFMLLALTINSVESIQSFIFYLIQYSLSNLNAFILLVAIGYSLYAYNDKNINHNNLVDKNNSPIQLISQLKGYFHINSMLALSLSITLFSFAGIPPLMGFFAKQMVFSAALQEGFIFLTLIGVLTSVISAVYYLFIVKTMFFDRHSYTYFSKLKDLKIPAIILQKDKEVNRIYFDSKFALSSSLSITISILTLIILLFMVMPNE

SEQ ID NO: 43091 - protein, 146 aa, A.fumigatus
IILLVYIYIFFYVNKIKYKMITSLISIIEGLLVIVPALLSVAFVTIAERKTMASMQRRLGPNAVGYYGLLQAFADALKLLLKEYVAPTQANIILFFLGPVITLIFSLLGYLVVPFGSGLFISDYSLGLLYALAVSSLSTYGILLAG

SEQ ID NO: 43092 - protein, 175 aa, A.fumigatus
SANSKYAFLGSLRSTAQLISYELILSSVILLVLLLTGSLNMITIIESQRVVNFLFPLFPLFLVFFIGSIAETNRAPFDLAEAESELVSGFMTEHSASIFVFFFLAEYASIVLICVLNSILFLGGYLSIIPLDFIIYILNLFFNVNDTILYDIYIHISSSPLNLAFKTAFLICVFI

SEQ ID NO: 43093 - protein, 132 aa, A.fumigatus
LIEYTCTKLDTINTGNNIETVNESNLKFHNTYNDSTSTHLATFIVTGILLKPTSKKANIAKNVVVITEVHVIICAPLTPTFLPKKPEIIEPNKGKIINVKYIIYIVLIYFLLIYNMLLKFLNLLQILLLLLL

SEQ ID NO: 43094 - protein, 88 aa, A.fumigatus
RIVWFSVYIIYTILSDILFFSFFILIVYTNYGSTFWISITTLVISRITTSKSKKIISFITTTHIKSTYIYIKSTYIYIKSTCIYINFI

SEQ ID NO: 43095 - protein, 61 aa, A.fumigatus
TIPTFIYEYENFFYYIKYLFTYFISYIINNFDIFFISCKINITPCLFTHRTSHRKISLNTS

SEQ ID NO: 43096 - protein, 74 aa, A.fumigatus
VIVTPDDNKIIVFNNGNSKGFTPCIPNGGHCAPNSILGEIALWKNAQKIAKKKNTSEIMNKPTPKFNPFCTAFV

SEQ ID NO: 43097 - protein, 75 aa, A.fumigatus
SGLFIFLSFYKGFFPYFKVAKLSFTHLYTTTIQFIKLISRSISMCQVLGQRSIRAIIKLKKFLLDLIVYIIYLYC

SEQ ID NO: 43098 - protein, 78 aa, A.fumigatus
YATKIPKPIADSAPAIVIIYIANVCPNISSKLSELINIKNVIDNNIISIEINISMMFFLFNTKPNIPIKNKKIEKFIV

SEQ ID NO: 43099 - protein, 108 aa, A.fumigatus
PDSILAASLNPNDTFLDKYEMNSIKTNKGNNAKGQPEGTNNEKNFNPCLWNPKNVAPKTTVKLIENVKIKCDVDAKLYGTNPIKLFANMNINNAYINGKYNCPFVGLS

SEQ ID NO: 43100 - protein, 64 aa, A.fumigatus
NNNTSNTKNTANNNVSNNNIITTNDNTFCDCIEFQFDNIAIGIIIVVNNTKYIDKPSTPKYISK

SEQ ID NO: 43101 - protein, 62 aa, A.fumigatus
  UNSURE (31),(53): Identity of amino acid sequences at the above locations are unknown.
RSSKHSPTVTALLPYSGILLNMCSVKLWNVXLLHVVSNNDPELLETSHGQQGXTKRISWKMK

SEQ ID NO: 43102 - protein, 212 aa, A.fumigatus
  UNSURE (10),(32): Identity of amino acid sequences at the above locations are unknown.
FIFQEIRLVXPCCPWEVSRSSGSLLLTTCRSXTFHNLTEHMLRRMPEYGNKAVTVGECLEDLQEFWYREAGEPFSNNAVRSSSSPELHDAPSTVSKPVSPDGKCGKDYTCAGSSFGPCCSSSNYCGTSNLHCGFGCQPEAGNCFSLDEPSHNDTNDFIRKPTPRPGSDHSNDGGLPGGGSARKPVKSGANPAVHALSAAACLMLFICVMAIA

SEQ ID NO: 43103 - protein, 97 aa, A.fumigatus
  UNSURE (94),(97): Identity of amino acid sequences at the above locations are unknown.
ESRRRNIYCFCLSRLPLGTLVRKAEMGRFGVGQKDRVTMWGMFYSCNGNNDDTNKMIIREDEDVSNACLTTRSTSIAHANTWSSPRERKDQERXFYX

SEQ ID NO: 43104 - protein, 70 aa, A.fumigatus
  UNSURE (5),(26),(31),(39),(40): Identity of amino acid sequences at the above locations are unknown.
PVGDXFLRWVQFSTSELASIFWGYYXFPCGXISSVLFVXXSGRVGIWTQIFSANHGIRGRFPTVSATVNV

SEQ ID NO: 43105 - protein, 163 aa, A.fumigatus
TSSFLRAATAGTDLLAPKLHDEDSVEDNWRGVVDVIDALLERADACLDEFTGVIKKLSPSQQEQSAAKAAKKASPKFPSVYDFGPSKIPKPQLLFERPPDNTDVSPFKPLLRIKPHAIVPLEDSLKLTDPAQGYRNPYETEIQAAKYPESTYTVSPPGRVPAV

SEQ ID NO: 43106 - protein, 101 aa, A.fumigatus
SICRLPRCLALRAMNTVEGSDSILTATRYKGMAAPAPGGGAQSPRKSVSPQNTGFSQIQARNLGEGGSAQQMSVLLSWHEKLVELTGTGSIVRVMTDRRTV

SEQ ID NO: 43107 - protein, 126 aa, A.fumigatus
PLVSRQRTLDDEELDSGDDIDRYDRAGDLMDEDGVEGDYQETVNIMDLSLGRAPEPVTSNGEVGPVGPKKSMLSCWLTLYTQVYTMPVPTFLSIETEEFDPETYVAPPFNTAATSLCWRHDPNDES

SEQ ID NO: 43108 - protein, 159 aa, A.fumigatus
  UNSURE (145),(146),(147),(148),(149),(150),(151),(152),(153),(154),(155),(156): Identity of amino acid sequences at the above locations are unknown.
AVESPNAIMGQADAAGFSGSSHGNATQGAEDLSSAASDIDMNDVTDACHGDVAPTSSSSFESMIIRTPNEDLPYLFVGSGSCNPLDPKASNCLGLALVRSIDVPSRKLELITPIPASKLRDALEQGHGIVLVRGMLDNPSWAVFXXXXXXXXXXXXSVT

SEQ ID NO: 43109 - protein, 120 aa, A.fumigatus
  UNSURE (24),(39),(52): Identity of amino acid sequences at the above locations are unknown.
SPPILAFTKITGPDKLTKWVFAQXPSVFKEVNPAVKQEXERALHEQKLAKMXAEMKMVFQQKVAEKESKLKQSEDELYARHREMKDQLERQRQELEEKKARLESGRPIEEKGKRKGFSLR

SEQ ID NO: 43110 - protein, 200 aa, A.fumigatus
DALPSSPVGVDDYSTPQHGKIHDAKAKKRSKSRLSTSRRREMELLINTPPSIAEEEPTDDHANFTATPSSEAITSESAIYVQGMNVLCAPFLYVARSEVEAFALFHYFMTSECPGYIRGAMDGVHRGLRLVDRCLEIVEPKLAAYLFSKGMQAELYAFPSVLTLCACTPPLPEVLHLWDFLFAYGPHLNILCIVAQLIRM

SEQ ID NO: 43111 - protein, 152 aa, A.fumigatus
  UNSURE (149): Identity of amino acid sequences at the above locations are unknown.
TNPQRGVFAIFSAADYRVYSLPTLELYPCRRHSDVLVVDRLSRGATPSLAVFSDAGSVEETKEGKDPSTAASIHYVCTSSCALIYSADHFLICGRRFGTVALLLQLIPGLSMFFLMSTAAGSALWVKDIENKRDALRGTSSPQGPGRSXAKR

SEQ ID NO: 43112 - protein, 120 aa, A.fumigatus
  UNSURE (120): Identity of amino acid sequences at the above locations are unknown.
SQGMRSLLAAICLSFEGPDDDLIQQIFPRWVRYSALLTVNVFVFMGNMYSVRTDDSSLPDNQGLTIFIQSGIATGFGSLAEDLQLPFEKLSDLISYSVLAMGLANIFWMPLALCFGKRPX

SEQ ID NO: 43113 - protein, 200 aa, A.fumigatus
  UNSURE (200): Identity of amino acid sequences at the above locations are unknown.
YCGWFGFQRTPITSLHYMIFVLAPLCRHSMACVHQIACLTHDLANVFLQNFFNIINGETVSSAVTQHGINPANKEPNPPVPVASPAELDKAVAAAQVAFEQWSPFPLEDRRKALFAYSDALNAEKDGFTSLLTKEQGKPLSQAAMEVEMAVAWIKGLASLEIPEVVLENSSERKIVQRFTPIGVGLHQGRKSVHFKGPQX

SEQ ID NO: 43114 - protein, 194 aa, A.fumigatus
VTHSADSSAACGEDGTCIFMNRISSETIFTTAPDSESTGLVGVNRKGQVLSVSVDEGTIIQYLMENPAMSGLAVKLASKAGLPGADHLYQQQFDNLLAQGNYSEAAKIAANSPRGFLRTPETINRFKNAPQTGQQMSVILQYFGMLLDKGSLNKYESVELVRPVLQQNRKHLLEKWMRENKLETSEELGDIVRP

SEQ ID NO: 43115 - protein, 70 aa, A.fumigatus
  UNSURE (58),(59),(60),(61),(62),(63),(64),(65),(66),(67),(70): Identity of amino acid sequences at the above locations are unknown.
SANKLGRRPYLVEAAQGLELGQFLYSALEVEVYETWYLGVNICQRYINRLLSRRHVFXXXXXXXXXXVFX

SEQ ID NO: 43116 - protein, 123 aa, A.fumigatus
PLVSRQRTLDDEELDSGDDIDRYDRAGDLMDEDGVEGDYQETVNIMDLSLGRAPEPVTSNGEVGPVGPKKSMLSCWLTLYTQVYTMPVPTFLSIETEEFDPETYVAPPFNTAATSLCWRHDPN

SEQ ID NO: 43117 - protein, 130 aa, A.fumigatus
  UNSURE (11),(14),(64): Identity of amino acid sequences at the above locations are unknown.
KIPSGGFPSSXSDXWNPRKTRTLVFRIWGNGEQLSLGFIAICARAGNPRFCLFHCSTRVSGIFXWFRRATCNVGLGSRMIGAMTTDHQLPQVFGKVTKKGVPYVAVIAAWLFGPLAYLSKSLRLVIIAHD

SEQ ID NO: 43118 - protein, 123 aa, A.fumigatus
YIRFYAALKAQGIHRDTLPWKGPLQPYAAWVGFIGSTIITLVAGFPVFLKGNWNTSDFVASYIGIPIFIVPIIGWKFWHRTKVRPRSLYVGKEANGCSLLAQPLLTYGLAVSRRERLLRNTGR

SEQ ID NO: 43119 - protein, 78 aa, A.fumigatus
  UNSURE (2),(24): Identity of amino acid sequences at the above locations are unknown.
VXGSMKDINKGNGIIYWGIEYMLXLFTFGVTGKWMGITLIALLEIFTYNPYKGRGQASNSIKGFQLNFESFPMVLQKG

SEQ ID NO: 43120 - protein, 67 aa, A.fumigatus
YFDPSFCAHFAKLRGLCGCTTALIIAQSGWSRGGRTSSYMALAIDSDHHAESLVTYWIYLYFFTRNG

SEQ ID NO: 43121 - protein, 157 aa, A.fumigatus
PYLLDPGALVYDPCIGQFDYVQEEVPAVPFVQQNANLFNFNASFMAELERLHQTCGYQDFIDKYLVFPPSGVQPPKMFNYTSDAECDVFDMINTAAMAVNPCFDIYEINLMCPLAWDVLAFPTELVYQPAGATVYFDREDVKRALHAPSIKWAECAD

SEQ ID NO: 43122 - protein, 140 aa, A.fumigatus
VIKQDLLINSDVPDRIGWAFGLGLERIAMLLFNIPDIRLFWSRDERFLSQFKAGQITRFEPFSKHPACYKDVAFWLPSAAVSGGSAAGGAVPIHENDIMEIVRGVAGDLVEDVRLIDEFTHPKTGRKSMCYRINYRSLER

SEQ ID NO: 43123 - protein, 194 aa, A.fumigatus
  UNSURE (177): Identity of amino acid sequences at the above locations are unknown.
SLSKWQYDSQIAHELGKVPPLDMARELMMVYFKVWHPLFPFLHGPSFLRAMELLYSDSHGTEGQNYGNIPSTSTSTSTSMDHRNACWTTIFQCVFNLASHLRPDLSLPPESRIKSPGSMHSLLAILTRRQDLPSLQALLAAQLYLVAKMSLRTASTVGGSILRSMLHAGLHPMPVSXSTRPGRKQHVPELEGSR

SEQ ID NO: 43124 - protein, 115 aa, A.fumigatus
  UNSURE (78),(79),(80),(81),(82),(83): Identity of amino acid sequences at the above locations are unknown.
PPHPLRLLPAVVKTRSSEGLSLDKILYGFGIFYAQGQKIFPEAATLGTVFYVGSISCLSWQRARSLVHHFGKVLKAAXXXXXXSAHVALWWLSRRLIETLYLMNTFGRSVNKSSM

SEQ ID NO: 43125 - protein, 78 aa, A.fumigatus
RPNNLPHLPNEIILVIAGYLNPHDLLLLYAIPGIIPLLNHAHRTAVDTEGNTLLHIAAVNNIAYHSIYQTDWPLLSQT

SEQ ID NO: 43126 - protein, 61 aa, A.fumigatus
DHLFNYSVHIKIIHLSIASIRIDYWVYCLSILQMKMPIFSSTPSTSVVDAVSLYSTTKPLV

SEQ ID NO: 43127 - protein, 216 aa, A.fumigatus
  UNSURE (213),(214): Identity of amino acid sequences at the above locations are unknown.
QILKYDGVVPHSRHSRHTRTPYGVQRVASPVLKQSQRAKTPEKSTMAERPRPTVLRRVLTAIIDPVDREEQGYHQYPTMRGLHDPENEGLSMGSANNPQLARRLTVATTHASTLIPPSDKLLVFRALTGIDTVPALAIPHHHPRSAPNVGIYTRVVRAEQAAAQQFRFFSILMNTCLGIQIVVAAALTALGAARGPHNAVSHTGLEGYAVSAXXNP

SEQ ID NO: 43128 - protein, 255 aa, A.fumigatus
  UNSURE (155),(163),(193): Identity of amino acid sequences at the above locations are unknown.
WVLYLYNSANGDTGSNQWSEDDKLVGREVFTWQSVLDVWQRGAEATRWRIHDSHLVWDRFLDLQVQDLSRRPSQERASQVKAFFDVRLQTPHATWDQTFQAFSGFVSTYYNANYEEIMADTAGRLATPVKEKYNAREHLEIKLRNAVDAGEFGLXWAAYSEYXDWEVSRHRRRRQSDFDLVNAIYQRAVLRFXDDSNLWEDYVMFLIDQNTHGNAGATTISTLDRATRHWPCSGTLWSQYLLSSERGWQSFQPDR

SEQ ID NO: 43129 - protein, 119 aa, A.fumigatus
HIAGIRNAPVPFFIKPLTGMVASKVEQAFVTPNLTSHFEFLEDQLKTVPGGGPYLCGKELTAADIMMSFPVIASLIKMPDLRGRYPRLAEYTDQLQAMDGYKRAVAKVEEIEGSFSAYA

SEQ ID NO: 43130 - protein, 175 aa, A.fumigatus
YSDSGSQYAKSENCPLNVCCSEYGFCGTTTGFCGDATVAEPVCDGTSATKKTIAYYEGWNSERACDTMPPENIPIGGYTHINFAFLYIDPDLYTIKPMETSQQELYSRVTALKKRKNGLEVWISIGGWAFNDPGPTANTFSELAASKSKQSTFFESLLSFLDKYGFDGVDLDWYC

SEQ ID NO: 43131 - protein, 145 aa, A.fumigatus
TKAVLKFIAPYTRFSLSFISKHIKISVPEVQDILSYLILDKKLNAKIDQENGTVVVESASDVDRLRALQDWSASLRSLWQATLIDGEGFKSDDPAQLHGMRGGSMLQSAFGDEAPTAGLRASNFRVRTGWKGKGGQGSKAGVGAF

SEQ ID NO: 43132 - protein, 125 aa, A.fumigatus
FPDSHETVCGSCGLVLADREIDMHSEWRTFSNDDHNNDDPSRVGYATNPLLNGDQLETHIASGGSGRARQLYRAQNKQSSDKANKALLAAYNEIGALCDGFNIQNNVPDTVKFLFKIVVHAQAFK

SEQ ID NO: 43133 - protein, 87 aa, A.fumigatus
RSHEILIGGCIFIACRQCKIPRTFTEYFDVTKVPPKEMGMIYKALEKFFTVQKLERDSCVVFYWWCSRIPTRAYLANNFYNPSLNFL

SEQ ID NO: 43134 - protein, 90 aa, A.fumigatus
AANRALFALSLDCLFCARYNCRARPEPPLAIWVSSWSPFNRGFVAYPTREGSSLLWSSLENVRHSECMSISRSASTRPQEPQTVSCESGN

SEQ ID NO: 43135 - protein, 184 aa, A.fumigatus
  UNSURE (79),(173): Identity of amino acid sequences at the above locations are unknown.
VLEFVQRARKAEVSAVESTRDFPEDRRLNRILAADSIVLVKNESGLLPLNPQTLTSVAMIGPNMKTAAFCGGGSASLQXYYSTSPYQGITSQLPPGVEVLYETGATSYAFIPELAASEVRTPEGQPGLGMRFYRDPPSVQERRVVEETIIQESSWQLMGFSNPELDRLFHAHXYTTGLEAKRAG

SEQ ID NO: 43136 - protein, 91 aa, A.fumigatus
  UNSURE (89): Identity of amino acid sequences at the above locations are unknown.
ETMALDGETNLKSKQPCQSVAKVCGTVEDMCSNSIHFAVEDPNIDLYKFDGNVIVNADKLPLTNTEVVYRGSILRKSSPRGWMVQAAAXIR

SEQ ID NO: 43137 - protein, 64 aa, A.fumigatus
FTMIDQPTYYHFHIHVVNVMLEAGATQVTGKAFGLENLISQFETLGRDQDACMTGLTTAERSSI

SEQ ID NO: 43138 - protein, 191 aa, A.fumigatus
ETMTYTDGTWRIQAQAQGGQQFHDLKLNLIWPCTEQHIKKYSDQQLRMVTETPEIYRDYVRPYMSAQREEGRLNWVFNILEGRTEQEDIILRDAGEGPDDGFLMLPDLNWDRKTMSSLHLLALVQRRDIWSLRDLKKKHIPWLRYLRQRLLEGTVKMYPELEQDQLKLYVHCKYYSLGGFAWVDGMCTDLR

SEQ ID NO: 43139 - protein, 71 aa, A.fumigatus
ISGLEADQRVLAAHGVYALTATTGLTAQNTLGVQDIFIVPAQFVKKQINAGLEDVGADGLHHGLRGIIAWI

SEQ ID NO: 43140 - protein, 268 aa, A.fumigatus
  UNSURE (10),(39),(267),(268): Identity of amino acid sequences at the above locations are unknown.
TVLNVSLFKXPNPPARATVACGDELPEGVNVMVSFIVDXGDRDARQGLHVQSRSYWAPANIGPYSQAMSIPLRGAEHIVYIAGQIPLEPAFMQMVCDSAPTEERSWLSDYSLRAVLSLQHMWRIGVTMHVDWWLGAVAFITGAENIAAKAQVAWHIWETMNRKRDDESIDEEESSFDVWDIKYGRRTEEQTPKATVSASIPNFEVLRSSGVTPPFLAVQVEELPRASDIEWQGLGYRCDGLELNAEETDQGRISLHAPGLEGNALRXX

SEQ ID NO: 43141 - protein, 168 aa, A.fumigatus
  UNSURE (20),(24),(36),(39),(78),(97),(101),(103),(108),(112),(113),(114),(115),(116),(117),(118),(119),(120),(121),(122),(123),(124),(125),(126),(127),(128),(129): Identity of amino acid sequences at the above locations are unknown.
PRKQRKQPRRRKNPPEGPPXRRKXGPRKRKRKRHTXQRXDPQGKARKKQSGPQETRNTGRKPGNAEKHPTPKGRRGPXPPQEEGKDKPQPEARREAXNRNXTXKRRWXGRGXXXXXXXXXXXXXXXXXXHPQTHHHHPQYLPPPSPIQHKVRPHRLTSKLLRPTRWRL

SEQ ID NO: 43142 - protein, 315 aa, A.fumigatus
  UNSURE (20),(23),(36),(39),(78),(97),(100),(101),(103),(107),(111),(112),(113),(114),(115),(116),(118),(119),(120),(121),(122),(123),(124),(125),(126),(127),(128): Identity of amino acid sequences at the above locations are unknown.
QENRGSSQEGGKTPPRDPHXGGXEGPGNGRGKDTRXNEXTHRGRQEKNKAAPKKPETRGGNQATQRNTPHPKEEEGPXPHRRRGKTNPNPKQDGRPXTEXXQXNDVXRGGXXXXXXEXXXXXXXXXXXTTPKPTITILNTSLRQVPSSTKFDLIVSPANSYGRLDGAFDDAISRVFCQPPKHEYNTLTEATQKVLYKQWRGFAPPGTCTLVPFPDELIGENEWGCRWVAICPTMRYPDRVTWDREIVYECVWSLLCQVEGWNRGCKKEKRIESILITPLATGVGKVSAAKWAAQFVLAMRHFVFTHRGWKDTRSG

SEQ ID NO: 43143 - protein, 246 aa, A.fumigatus
  UNSURE (29),(230),(232),(238),(239): Identity of amino acid sequences at the above locations are unknown.
CGTLNQYYFGEAFDEQRVTGAEIERGVIXLYSNLVRFGYFDGNESVYRDLTWNDVVTTDAWNISYEAAVEGIVLLKNDGTLPLAKSVRSVALIGPWMNVTTQLQGNYFGPAPYLISPLNAFQNSDLDVNYAFGTNISSHSTDGFSEALSAAKKSDVIIFAGGIDNTLEAEAMDRMNITWPGNQLQLIDQLSQLGKPLIVLQMGGGQVDSSSLKSNKNVNSLSGVDTRVFXEXAKALKXXSSLGRGS

SEQ ID NO: 43144 - protein, 83 aa, A.fumigatus
QSHSTLTVLAAVQLKSAELARAAWDQFLHTDGYTEEHDWRVVETAPPEYFTHGEEAEWITTNEDARYGVSAMFNLANIREYLR

SEQ ID NO: 43145 - protein, 60 aa, A.fumigatus
DRLGLLMAIQPYTLPPHSTPHNTHTQTPQDDPPDSPPYQSPRLPRDRYRSSTPYHIQPPL

SEQ ID NO: 43146 - protein, 60 aa, A.fumigatus
AGVCHLNSNDYSCTSAAAGLPKIMYYCRFRLIAPLFTCGFQNDQPAAAPSHSPGVVYPQM

SEQ ID NO: 43147 - protein, 60 aa, A.fumigatus
VPRGIYQHSNASLTLVSTMHVRILRGGCEVEQWNCVTSGGKRPLGCDSEQPQVDHSGNHR

SEQ ID NO: 43148 - protein, 104 aa, A.fumigatus
  UNSURE (70),(95): Identity of amino acid sequences at the above locations are unknown.
ELRKTTLRLPSVVIPHQPDTMESGSEEEIDIQYTDWESETDPTASESDEAFIVYDDEPIEMEDYDSSYVXTESEEIALVHYRLRLWRNIQRSKMXLPRRLASYL

SEQ ID NO: 43149 - protein, 254 aa, A.fumigatus
GRVISTPREDYDVSMKYGVRATPTFMTFLKGKKLDEWSGADPAKLRGNVRLLIEMAHPTHRHRQLHLPSFQRHLSNFVMYKKVPPLDKVVQRLQPHHEDPRLKSMIAFITARSSSTTPTSPAADVALPEALPTFASYLQSTFHALPPENQFALVDLARLLFLDTRVSSFFAEQPNHTTLLNLLSPSTKLSSCPYNLRIVMLQLICNLFSSPLYLDHLTTNTANKNKLHTTVLNLATSSLLEPHPNLRTVAASLT

SEQ ID NO: 43150 - protein, 174 aa, A.fumigatus
  UNSURE (15): Identity of amino acid sequences at the above locations are unknown.
DRSASLEPCLDGFTXRDFLSGLERTVQRNETTLTEYNRIRPDPPMIEASNENAPLTRKEMSRQVQTLLTPETTLFVDTGDSWFNGIKMRLPHGTKFEIEMQWGHIGWSIPASCGYTVAESQRQVVVMVGDGAFQMTAQEVSQMIRYKTPVIIILVNNQGYTIEVEIHNGIYNQI

SEQ ID NO: 43151 - protein, 102 aa, A.fumigatus
  UNSURE (5),(7),(26): Identity of amino acid sequences at the above locations are unknown.
QFVRXNXRHEEAKMVLDELSSDLESXGIHSQAMADRATSLRAQARAQGLIGMERSLSMLIWNYYLASVDQHSSEAVTLAEDLADELMSTHTTVDSLAGLSPE

SEQ ID NO: 43152 - protein, 162 aa, A.fumigatus
  UNSURE (153),(154),(155),(156),(158),(159): Identity of amino acid sequences at the above locations are unknown.
RIYIHSLMDSIASSGSGRHSTSVLRLCHDLCTLHGREGQWKQGSDCAWSVLKHVWPDVHNPTSEAKFRSDRAPLIANIVLDYAYCLFRRLDVANATTVYGNAFKASITAEKVTVPHLTAVVKTVVEFYETTFQFSKALVLLRLHHGCKDVQKXXXXKXXRWG

SEQ ID NO: 43153 - protein, 203 aa, A.fumigatus
WPLQRLLEPRGEDAGKYGEDSKLIYDLQDQGGELCSLRYDLTVPFARWLAMNPDVRSIKRYHIAKVYRRDQPAVSKGRMREFYQCDFDIAGAFDPMVSDAEVLRIVTEVFEELGWQGRYTIKVNHRKILDGVFEVCGVPPEKIRPISSAVDKLDKMSWADVRKEMVEEKGLHGEVADKIEKYVAGKGARDLLESLWKDESLTA

SEQ ID NO: 43154 - protein, 184 aa, A.fumigatus
QCRITTEDPANGFRPDTGKIEVYRSAGGNGVRLDGGNGFAGAIISPHYDSMLVKCTCRGSTYEIARRKVVRALVEFRIRGVKTNIPFLTSLLSHPTFIDGTCWTTFIDDTPELFALIGSQNRAQKLLAYLGDVAVNGSSIKGQIGEPKLKGEIIKPTLLDDAGKPIDLSVPLLSYTRREAKDHA

SEQ ID NO: 43155 - protein, 89 aa, A.fumigatus
NSTLPTRKQKIAGIQSMTAVIEGITPGSGAYSNEANPFTINWREAWWGENYERLLRVKNKYDPRGLLKCWKCVGWEESDAATSPFAAFV

SEQ ID NO: 43156 - protein, 74 aa, A.fumigatus
TMMLDGVPQPPEPIEAKQNDQEKALDDGADLKPIDNTPYIDPFGDEQNAEVKYKTLKWWYVLRSRSIYDKGVDS

SEQ ID NO: 43157 - protein, 67 aa, A.fumigatus
  UNSURE (26): Identity of amino acid sequences at the above locations are unknown.
GPCPDNITGKDIGHLSWICMSALMAXECQARNALFIPIGYMAPTGISITSACACHTRNANANANALV

SEQ ID NO: 43158 - protein, 201 aa, A.fumigatus
  UNSURE (20),(23),(28),(39): Identity of amino acid sequences at the above locations are unknown.
SPVLLPKPVDWLTNIDVWGXSMXPGASXYTPPDDVVKFXQDGPPPIYVGFGSIVVDNPTKLTRIVFEAIVKTGQRAFVNKGWGNIGAGEAEIPQNVFMVGSCPHDWLFQYVSCVVHHGGAGTTAAGLALGRPTIIIPFFGDQPFWGSIVYRAGAGPAPIPYKQLNAEKLADAIDKALGPEMQEKAGEIGATMVFTTGGNPR

SEQ ID NO: 43159 - protein, 83 aa, A.fumigatus
PRAIWARSLDFTQATSFPPITSGPASGTVLPCLPKAPHTPAAYPPRPLGSENESLKGMGFPPRPPNLSEAERIAPGPQAPKKA

SEQ ID NO: 43160 - protein, 152 aa, A.fumigatus
YQNHLTSYLRDQICGVKGALACASYTAATIWPYKLIMHLLVSLLASGKVNLQTHTPATAVTPSADGKFTIDTPRGSLHANKVIHTSNAYVSSLLPQYKHNIIPCKGICCRITVPEGQTAPLLTNSYIDRTKDNVLSYLIPRADGSIIVGGAS

SEQ ID NO: 43161 - protein, 98 aa, A.fumigatus
GSKHNKAIILSSIPHPYPHQQHIPVNNKTENHPVRFAMRHPAHESIQSDSTPLLSAQRMCQGLAVCYLRRKLIVVSLLLSSCSHLILSYTDGDGRTRD

SEQ ID NO: 43162 - protein, 158 aa, A.fumigatus
AGVSLEADSYKADASLSEQGEDYAKKMTERLLQHRESEKQAMIDRGETDYELKPLTVWTSTRRRTVETAKYLYEKGYKVRQRSQMSQLNPGVCEKMSERRIREEYPDEVAKHELDPYHHRYPRAEVSLISASNLTLTTRAYHYDSPTMTLRCDLNPSF

SEQ ID NO: 43163 - protein, 70 aa, A.fumigatus
  UNSURE (2),(31): Identity of amino acid sequences at the above locations are unknown.
PXNPKVLRYLRGAVSWDQNWDHMRSEGETTXLASFTLTTGTRLKNLARAGMPWCHPRAKSAPVGYFGAPL

SEQ ID NO: 43164 - protein, 63 aa, A.fumigatus
QFACTPEGYIMRECITNDARIAEPLVGQSLIMSAMRKEWHTGSKNGMESSPRGSKVRRYAYSN

SEQ ID NO: 43165 - protein, 281 aa, A.fumigatus
  UNSURE (26),(34),(49),(60),(80),(93): Identity of amino acid sequences at the above locations are unknown.
GNHLLGPKASFPMAEPNQFPFLSPRXQSPETPPXATSPSFHTPSPAAPXIMKTGTAKGSXNAILEHLGYTPELSRNRSVXQVAFMCFILSSVXYGLATTFFYPLAAEGPSTIVWGWIIVSLVILCVAISLAEITSVYPTAGGVYYQTFALSPPWCRRAAAWICGWAYVLGNITITLAVNFGTTLFFVACLNVFESEPGVGIVDDMQTYQIYLIFLAITLLTHAISSLGNKWLPSLEVCFFSFLFFFLFIFQCFPSVATRVSWLPMRLLMRFVSPYRFRPSS

SEQ ID NO: 43166 - protein, 62 aa, A.fumigatus
RNGLNQIVVIRLTQGEMSSGVTHTLSTLNPETCPEDKATALPVSRCRQIVFTYRSRGTAHAM

SEQ ID NO: 43167 - protein, 63 aa, A.fumigatus
IKLLLIGDSGVGKSCCLLRFSEDSFTPSFITTIGIDFKIRTIELDGERVKLQIWDTACQERFR

SEQ ID NO: 43168 - protein, 66 aa, A.fumigatus
  UNSURE (17): Identity of amino acid sequences at the above locations are unknown.
PFWTRYFPAPGRVDRLXKVKHIIWLEKHLRSMCRERSKGLPLQYILGDQPFGDLEILCERGVLIPR

SEQ ID NO: 43169 - protein, 188 aa, A.fumigatus
  UNSURE (54),(56): Identity of amino acid sequences at the above locations are unknown.
FATNLTADAASAYTLLSWIGDTSWLDMTAYNYVPSYSLTGPSTSTNSSTTTPAXTXTPSATATATWGHPTSGTTPPAGAVIVSQGGSVNWSYSNLTDALAALPNDASTQIIFIYPDTYTEQVPSINRKGPVQIIGYQSGNPGKTYRTNQVTITFARGLSVSPLPTGHSDAETATLSTSYTPGGGRNAV

SEQ ID NO: 43170 - protein, 70 aa, A.fumigatus
SPLCPPLYLFLVTISAYPKLAASYLSLFPGDIPLLGVDHLVADPIFFLPLLPTTRLLHLRIICLFIFRRF

SEQ ID NO: 43171 - protein, 86 aa, A.fumigatus
TCYFPAAVVKISLVNFCSLLPSFRPPSFPLPLSRAIRVTADSLQLLLVDSCPQLTYTPLPPHISLGLWLCYIYKLLNPTRLDGLLS

SEQ ID NO: 43172 - protein, 195 aa, A.fumigatus
QQQEEEKSRNILPKSSSSSSVDNPRKQTEKIATECILYGYRSKDGEWKVIDKYEKISRGLICEDYPRSDPNSTNGFAQLLSGGDVVIRSNLSADANRKSKRYAGGFHWIKVTFDSTIAADRACFYSPQEIDGHLVFCELYHGSGPAEDAPIPVDSSRAVQFKSKAPRTLTTSHFTTFLHPQDKDRLTRQRAEGME

SEQ ID NO: 43173 - protein, 71 aa, A.fumigatus
TAEVGFTVPNSWTHWQDAEARGESSICKIQTATPVGFTISYVFSFGVDIGRESCCIYNNGTKKLAQTVEWE

SEQ ID NO: 43174 - protein, 348 aa, A.fumigatus
PKLAPVTANIQFVKSLGKPMNVRPGSLFRRPRVSNSSFGSRSCNGSRTQNHTNHWRAQSYAFTSTRPTPSVRIRPGLPKPNPKPNENTTRHINNARSSELPKSGSLYQIRGLIGKMQKLEERVQSAKSKLPPPSDSPSRTSSRSGSILGESPVASTITARRNSRKRLSGSSFSSSVRDGDSVPSYAPHSRPSFGARTQGDSRPSSRTSYSSHSSVSHSTHPSVTPSTRPESRQSRTKTPLGHYSTNPTTESRRPRSSLSNPSNQNGVVNGMAHIDEDEDLAMHMSLRARISEIRETRLPSISTPPGLKKRTPSGISGIPAPRTLRTSTGFDRLEGGLHRGLRGSVYVK

SEQ ID NO: 43175 - protein, 125 aa, A.fumigatus
  UNSURE (61),(121): Identity of amino acid sequences at the above locations are unknown.
YLCLRVHDGMVGSGVLAAGDCLAAGDFGQGVSPGWDRVVWSVHYLSSSVTARVLTSAGIPXGFATAMGLGCAALTNNPAFPTYPHPLSPDQVAAGLSAPATAITLLGHGGAVLMLILLFMXVTSS

SEQ ID NO: 43176 - protein, 105 aa, A.fumigatus
RHLVFGFLVAARIELIGSPGRLYDLLQEASREMPIARNTDGSYLAFRSVGGLVFAIDIFVSGFTTVWLDQAYWQRAIASRPETSVKAYLLGGIAWYGRFIISPRL

SEQ ID NO: 43177 - protein, 179 aa, A.fumigatus
PDVLENLVSQTTIAEKIGQESTVLSWLLSRIQQKESPVSQNKQYAAEVLTIMLQSSHKNKDKFIGLDGVDILLQLLSHYRKRDPEKDSDEEEYVENLFDCLICLVDEDPGKEKFLEGEGIELAQIMLKEGKFSKQRALRVLDHALGGLGGGPACERLVEVAGLRTIFGMFMRKVGVLFK

SEQ ID NO: 43178 - protein, 116 aa, A.fumigatus
GILGDIKLIFRVADSFRSSVIERSQAGDRAFVDSIGTIGKPQIDILFIVERQLIVMLAENFGWSIILELIMILAKFTSVVEISILVLRTFGRTLEQIFYETKRIVGRIWSITFLSL

SEQ ID NO: 43179 - protein, 266 aa, A.fumigatus
YLRTLILTLDRLGDNISEWSKYRISISQMLAFASMFQVPMIGSDVCGFGGNTTEELCARWARLGAFYTFFRNHNEITGIPQEFYRWPTVAESARKAIDIRYRLLDYIYTAFHRQTQTGEPFLQPMFYLYPKDKNTFSNQLQFFYGDAILVSPVTDGSQTSVDAYFPDDIFYDWHTGAALRGRGANVTLSNIDVTENPIHIRGGSIIPVRVESAMTTPSCAKKASSSSSPQGLDGNASGQLVSRTNGDSLEAARRPSNWEFHLPQRA

SEQ ID NO: 43180 - protein, 152 aa, A.fumigatus
SDQTSAGSAATPPRSSALAGRVSEPSTPSSATTMKSPVSRRSSTAGPPLPSPLARPSTSATGCLTTSTQPSTGRPRPASPSCSPCSTSIPRTRTPSATSCSSSTVTPSWSALSPTGARLQLTHTSPMISSTIGTRAPPYAAAEPTSPSATST

SEQ ID NO: 43181 - protein, 110 aa, A.fumigatus
PPMDRHVNSDTTATSLTSIVYELARHLDEVDKLRAELDPIEADSDGEYQHDTLAKLPHLNGFINETLRLHPPIPGVIPRKTPPEGIHVKDVFIPGNMVFTKGAKDRAKRE

SEQ ID NO: 43182 - protein, 154 aa, A.fumigatus
KRRMTGRMVDKYAREVDDFAFLPIRGSRHRSEDEREAAHQDHRLRVTIGVTGWLTEEDNFVIPWRVIGAESEVFGLRWETEPLMNLGNALDLLVTSAAWTAGEQVLKKTFLSQLLTAVALPLGLLKVARVVDNPFSVSKARADKAGEVLADALI

SEQ ID NO: 43183 - protein, 60 aa, A.fumigatus
VVGDGGVGGLIVRGTSQLSWVSSPVLPVNQVSDLDWALMPSAGITYDDMKELNISCDLLC

SEQ ID NO: 43184 - protein, 151 aa, A.fumigatus
  UNSURE (35),(92): Identity of amino acid sequences at the above locations are unknown.
VHHLLLLALVCPWCKSRTLLRVQETDENSPPTPTXCAPSRVPPMATEPTTTASMYLASTSPASSRLPARRTSPGRTTTAPTAPSSRTLSSSXGPPKTPSITSSLSRTSTRTPISASFPSSPTSTPLAATSTPTPCTPPGLHHGGRRSRASE

SEQ ID NO: 43185 - protein, 240 aa, A.fumigatus
  UNSURE (176),(233): Identity of amino acid sequences at the above locations are unknown.
KGKGWGKVGGVSAGGLPASTTFLGGVQGAGVGTTWLNNGPLWNPRNGGNPRSTKWCSVYRDLDSVKHDPDHSVTGDHTELYGTYTPSKDAIADGTLKPTMNGSVEQQLAHHKGLDPKVADEEVMGYYSEDEIPTLVNLVDEFTTFYYWHSCVRGVSHEPYYEYKRLMRIAHQPQPXVRPLGYLRWPRNQRQQLRCIWRRHLQHLPGCQREGHHLEELRRHQRRLPLGRSLLQXDRPKRQA

SEQ ID NO: 43186 - protein, 120 aa, A.fumigatus
  UNSURE (7),(63): Identity of amino acid sequences at the above locations are unknown.
PTNPNRXCALSGTSDGHGTNDNSFDVSGVDISSIFQVASEKDITWKNYDGTNGAFLSDALFFXWTAQNAKHNVVPLENFYQDAYLGLLPQLSYINPSCCDLDTNSMHPSGSSPRGAKEPR

SEQ ID NO: 43187 - protein, 160 aa, A.fumigatus
VSSQQGATHESLLKNDIWNRDTVLLLLTYLIFALGNVSFNSLFPIFSHASPPTGRALTPREIGLSQGFAGLATILFQVCIFGRLRDKMGNRWSYRAGLFGFVLSFILMPFVGYKGDDADGRLTKKTAFMAIELCFVLLVKTVAAVGGLTSALLLVRLSFC

SEQ ID NO: 43188 - protein, 129 aa, A.fumigatus
PLAHSAETFFRMPRRKCPNPCAVYKYHPDEALSFWFFFSFGNFWHPTTLAHTTTMSIGKLLSNGALLVDVLIIGAGPAGLSTATGLARQLHTAVVCDSGVYRNAETQHMHKVLGWDHRNPAELRAAGRA

SEQ ID NO: 43189 - protein, 78 aa, A.fumigatus
IFSLHVYLWKMVYHLGYALERDLLVQEVGCLAPGTNFCIDPSSIYWGVSYYFSSEFRVMASSVGLLFLSLTSLLPRLL

SEQ ID NO: 43190 - protein, 68 aa, A.fumigatus
  UNSURE (65): Identity of amino acid sequences at the above locations are unknown.
LQETGDSQTLQDGIDCALCHFRQETPESPMHFELLQGMSDNILSYDTGCGLLPQRESKDARAIAXRRG

SEQ ID NO: 43191 - protein, 81 aa, A.fumigatus
SLITYHLSICLSFYNYRPFHRSISISLTHPTVATISTRLIPYLFSTLSIDIDSLVHHLDFISLSILSSKDILLEPRAYAHP

SEQ ID NO: 43192 - protein, 154 aa, A.fumigatus
RFTQPPMRRSPSTNRFSSSPIPEARVSSEETAGPSIMFAPSSSPPRFPNRLESIYTRLSSSGARSASGYPKQASVPLSFDDLPSRAQHLILNELMARQSSQTAVIFTTLPSPSEGTAGSEETSESYLSDLEVLWQGLPPCLLVHSNSMTVTMNL

SEQ ID NO: 43193 - protein, 67 aa, A.fumigatus
KRAQSQCFPSVMKRGLGDGTMAEQAGSIRTPAFGDQVVSASSTTLLLSCNPYSLIKWGAPAFKFADF

SEQ ID NO: 43194 - protein, 62 aa, A.fumigatus
  UNSURE (7): Identity of amino acid sequences at the above locations are unknown.
PKKPHFXPERSQTVVFSVRNSAFPYLDGSMTKVPLVLVKALFEVYAPPTLGRRKYTRALSAS

SEQ ID NO: 43195 - protein, 150 aa, A.fumigatus
TVPVSFWRTGWNCGSPSPLPLRLKRSFLMSISGLSFIDGGRSPFRWRFPIAFQIIFLIVLFAAVWFFPESPRWLVKVGREQEARYILGRLRGSSGDDAVRAEAEFRDIQSVAELEKTINHSNSYLSMLFGYKSGKLHLGRRVQLVIWLQI

SEQ ID NO: 43196 - protein, 143 aa, A.fumigatus
LIKKNNPTNTYPYYTIFKIKSPIHITYKTSLPNPQNINFILPLTILIHITHKSIPLSAHTHKNLPLSPSLSIHLPTMSIPIIPPYSLYCLHKLALSQSINHHSHINIPRPSNSTLPRSHSNKFLLFTLATTPNQPLNILIPPN

SEQ ID NO: 43197 - protein, 131 aa, A.fumigatus
TPSSPVLYALINPHMTLLAPFGTQNTVAYSRIPQGLSTPSKPPQSAIPEDSTLAGIRTALSRWRDHWLALRNTVSSHEWASMGFYKNGYNFWLVSQLLITKKKSVDVVMQMEVKCEDKLEKLKVLLQDEND

SEQ ID NO: 43198 - protein, 80 aa, A.fumigatus
  UNSURE (67),(68),(69),(70),(71),(72),(73),(74),(75),(76),(77): Identity of amino acid sequences at the above locations are unknown.
IHYAYPNFQNISIFVPVSSSIYAGGSANVTSSPCNSSTFPVNEASPTSCATARVAVDMGVRIIDLNXXXXXXXXXXXYST

SEQ ID NO: 43199 - protein, 73 aa, A.fumigatus
ITLGVDVSVNHDSVVLYAVTLTSDGGIANDNRDWGDQVAPALPMYASDGSGELMFNDPGFEAGPCSSWKWKYK

SEQ ID NO: 43200 - protein, 236 aa, A.fumigatus
MTDGGTKSVSPFPAGPVGEYICELYQGHNQLRELGLIGSNCLANARDFQAPVASFEDEEEPTEWRLYSKFNNTLFSARQDHTPFDIVAWHGNYYPYKYDLGRFNTIGSISFDHPDPSIFTVLTGPSDHAGTAIADFVIFPPRWLVAENTFRPPWYHRNTMSEFMGLICGNYDAKTGGGFQPAGASLHNVMSAHGPDADAFEGASNAELKPQKVGDGSMAFMFERYVVLRYIERFKY

SEQ ID NO: 43201 - protein, 77 aa, A.fumigatus
HFAAVSLSAKELANYVSTWSFLLLTYGVLASRRCKDAPTITEYMPKRQVGSEATKRQVRARPWFATTWFRKQNNING

SEQ ID NO: 43202 - protein, 188 aa, A.fumigatus
  UNSURE (164),(174): Identity of amino acid sequences at the above locations are unknown.
VTLARIFRPRGEDLAGRTKTGVTLQTLHVKHFDHGVILQQTPAPGFEIPNPDTCTVPELLNIVAPKGAEILLDGIRKGLFVPPIEDAGWRASQGDEPLIHAAKIKPEDRHIDWVNWTWKDISRRNRVLGPLWNKTLAVSDPTSGNPLFRQRRVILSEMEEVDTXKGCEAFSLIXGLPFVDSAHPIDRQ

SEQ ID NO: 43203 - protein, 147 aa, A.fumigatus
  UNSURE (138),(139): Identity of amino acid sequences at the above locations are unknown.
ATPDEKVAVPLRAHAFTATPESMRLANEEGPNQLDPKAITPGHLDGQGWPESFLDDFESRIWITYRSNFPPIPKPIDRDAFSTMTLSVRLRSQLVDQHGFTSDTGWGCMIRSGQSLLASAMSILLFGGGTNQRLDHVXXRDTRTSNR

SEQ ID NO: 43204 - protein, 78 aa, A.fumigatus
TPLSYNVILMDINMPVMNGLEATTKIREVNSEVPIIALTGNALKGDAETYLARGMNDYVAKPVHRKRLVQLLWKWLGS

SEQ ID NO: 43205 - protein, 75 aa, A.fumigatus
LKVGLDAPSFARTPIYHSSRPQLSGVSLILNEALSLVGFELSGYASFIASSIAKRNGLDGYQLLESSPRGWKIRD

SEQ ID NO: 43206 - protein, 193 aa, A.fumigatus
  UNSURE (113),(114),(115),(116),(117),(118),(193): Identity of amino acid sequences at the above locations are unknown.
YNYKTKSASSQQRTHITRFTLCPDLYTLTITDKAPNADNSVITYSYIGSVDPEHATSESRERNLVLVFDPDRKVFVLESIATQLNFNLRSAPNKTEKQVTEQYAQLRTLHDDXXXXXXDGAVETAADTDDGPADASNPYDYRHFLPKENADDDKSVSDGAISAHLNASKSNTPLMTGTAKPIFTTGPEGAEKX

SEQ ID NO: 43207 - protein, 97 aa, A.fumigatus
NPTLLWPLSLVLDIVMLVSVILTPALLLGVANAATLAKRWSNGDVATGTTDPNVASGCTYWANSIASSDTCESLNAYFGITIAQLVSWVRVNLSPLS

SEQ ID NO: 43208 - protein, 78 aa, A.fumigatus
IVGAVYQCKCNTLGGHSAYLHINELVQLAANAFHGVACNFHITKGKHSCTGDCPMGLMSLRRQFSRWRWMIEFLIFLI

SEQ ID NO: 43209 - protein, 133 aa, A.fumigatus
SLVSYSLSRTCQPSNQVQVLAVWAGLALNGDVVPEDELHVYVQDALDELEFLTGSVETKYGALRASVGHPEPWVIRYVEVGNEDNLNNGLASYSSYRFKAFYDAIKAKYPDITVLASTIHLTFSHTAGRRTSV

SEQ ID NO: 43210 - protein, 176 aa, A.fumigatus
RVCFQPRGEDISPCTIRNICSQLSSGRVSTRCLVSNSNITTITDSQCGNGIVEVGEECDCGATCDQNSCCDGSTCRLRAGALCDDAASPCCTNCQFASADTVCRPSTGPCDVEEMCTGNSTICPVDRVLSGGQRCGDGEGGSGNPSCSNGECRRNETSWVDSHRSLIIGLAAGIGG

SEQ ID NO: 43211 - protein, 74 aa, A.fumigatus
FSISTAFPKSKREDTKGSHNSPAVVIMWETVSSSTKGQQAANSGCTLSNKLLFSMSDDCGAVNGETMVVLVTPV

SEQ ID NO: 43212 - protein, 139 aa, A.fumigatus
QGASVRTVFSSVAASYDTMNDFMSLGIHRLWKDHFVRSLNPGSALPSRDNDATGKGWNILDIAGGTGDIAFRMLDHATNINNDHQTRVTIADINPDMLAEGKKRSISTPYYNTPRLSFMEANAQHMPVVNTPSGSMRRT

SEQ ID NO: 43213 - protein, 127 aa, A.fumigatus
  UNSURE (12): Identity of amino acid sequences at the above locations are unknown.
GDLPGHWAMSGXIIFWQMRSPSPFDTLGPGRGNARIEDRFLEQDHGEELEDWVYGEKIVYTRDTFFCCDHRQSAPDAKDARITWEQEQERRWRMRKELFPNLSDDTIILGNFNQLYKVSIVLMMMCD

SEQ ID NO: 43214 - protein, 149 aa, A.fumigatus
  UNSURE (140): Identity of amino acid sequences at the above locations are unknown.
SMLSLFIQIEPTTFRTWLRILARIPNAVLWLLRFPDLGEQNLRETAIAWAGRETASRIIFTDVAPKNAHISRAKILDLFLDTPECNAHTTATDVLWSGTPLLTYPRYKYKMCSRMASSILSSALPDSDAGRKAPDELTGXNRRAWKVLH

SEQ ID NO: 43215 - protein, 88 aa, A.fumigatus
KTDLGDVLDSIKLGDAQDGGGKTQTVALRGIHLQEIALRTNVTLERHDNSLPNRVNGRVGDLSEELAEVFVKKARLLRHAGQWSIITH

SEQ ID NO: 43216 - protein, 241 aa, A.fumigatus
  UNSURE (4),(5): Identity of amino acid sequences at the above locations are unknown.
WGYXXANLDRNGLRPCRFYVTDDDRIICASEVGAVDIDPERVVQKGRLQPGKMLLVDTVAGRIIDDAELKHTVAHRQDFAAWLDKELLKLPDINRKLLEQNVDLSYTLDDTTVQNDPRLKAFGYSFEQVSLLLGPMAADSKEALGSMGNDAPLACMAQQPRLLYEYFRQLFAQVTNPPIDPIREAVVMSLECYVGPQGNLLEMDASQCNRLRLPSPILSIPEFNAIKHITQVCLLRQPAEG

SEQ ID NO: 43217 - protein, 83 aa, A.fumigatus
RNRLLDVLAQRKDSGEIYGSILIDGRPQGISFQRTTGYCEQMDVHEPTATVREALVFSALLRQPAHVPREEKLAYVDHIIDLL

SEQ ID NO: 43218 - protein, 106 aa, A.fumigatus
TRIFQPFGQDYVLTALGLELLNSQGGSSVLLYKRGSQKTRSEDTTTPVQEAARASHAKQSTFTWHDLDYHVPYQGQKKQLLDKVFGFVKPGNLVALMGCSGAGKTT

SEQ ID NO: 43219 - protein, 81 aa, A.fumigatus
GGNAFFGPSTAVVEDAQSSTKALKSHEKKVTEDLKRSLKQEKQVLRPARKPFWFEKFLFFISSEGYLVLGYVVLLSLPCYL

SEQ ID NO: 43220 - protein, 220 aa, A.fumigatus
SNFGSGRDAMQSELLYRRHLKKGDIFVHADLEGARPMIVKNRPGTPDAPIPPSTLSQAGNLCVATSSAWESKAVMAAWWVNANQVTKTTTGGLLPTGEFEIKGEKNFLAPSQLVLGFAVMFQISKNSLKNHKIHIFEDATPTEPSAKESGTAKEIVDNEQSVAQDLGPAETDKCAANRPIEQERKSNSESENKEVEPGLHSAEGTPYSGGVSEPLYETKK

SEQ ID NO: 43221 - protein, 70 aa, A.fumigatus
GVAAVRDEVSVSDSALSLAFEMHQPKSLRKYLRELKLLAEAVVCICEFGGWGTQARSSLHNSRRRTLIPP

SEQ ID NO: 43222 - protein, 102 aa, A.fumigatus
  UNSURE (102): Identity of amino acid sequences at the above locations are unknown.
GSFGPSGFFDLEVATSTVVDWPTGVWWVTLDVIGDKETQRGTRKRRNNALGFDRRLARLIEKRFRSAYSNIVTRAMQDSMTPVTYNGRNKIASRLLHFPGCX

SEQ ID NO: 43223 - protein, 129 aa, A.fumigatus
SLSRTVDLELTISLIAAADDKGVVNNILTVGSSSIAAAPGAEAHAVEKETETPLENGASEKVEETAKEPGVQSTTTTEAVKDEVPEKTDDSVVVEKDLHVESEPATQEVKPKLVSEPSKPSDIHEDAET

SEQ ID NO: 43224 - protein, 217 aa, A.fumigatus
CEEVAGILESSGSYYLLDHLAFHPTLFHVSILVCYCIPLTRMMKSIRFLASALALCLVDAYLVTPPGTPAPGAASACSAWVQASYGLTCDIIHRFYGMTAAEFEEWVSKCPAAQLYPLNYICTDSAKKPSVSQLGDGCTLISGLYYCVQVNYIPQKSTLEPAHDYDTFHQLAQPGKASPRRLPTHTGLGEQLAPSSNWVVNGEPLLPNLQAAPGNIS

SEQ ID NO: 43225 - protein, 110 aa, A.fumigatus
  UNSURE (36): Identity of amino acid sequences at the above locations are unknown.
LACTFGSTVIAYLIASGIPFFNNLVSLIGAFLGVIXAYQPTGCMWFYDNWRKRDTGNWKWILMACWNVFVILIGSFMTVAGTYGAIVNIVNSLAEDGGSKPWTCADNSNS

SEQ ID NO: 43226 - protein, 131 aa, A.fumigatus
  UNSURE (103): Identity of amino acid sequences at the above locations are unknown.
PDKTYDTTDINHAASLHPRRTLRVNPLDRIARPPVPQTLPPSPGLPRSNYKSHLPLHPSRRPCRRGQRTPQQRHRRDRSSKRSPATYPALSTRDPQGVGYCTXRFKETETADPRHVMFEANSGTGFRNEPR

SEQ ID NO: 43227 - protein, 159 aa, A.fumigatus
  UNSURE (152),(153): Identity of amino acid sequences at the above locations are unknown.
CIPAKNDDFPSTSNTSTSASCLGSSRTFSLRPSCPTPPSPFNAKSLSSAPSARSSGSKTTSSPNGVSATEKSTPTRCPRSSLTTRKAISARRRFSGTAAHQRAPAMMTAPVSRAVWLHLPHLRVHFRIWRGRPPRQRSGLDGDHDADSCLLXXTPGTGR

SEQ ID NO: 43228 - protein, 68 aa, A.fumigatus
  UNSURE (64): Identity of amino acid sequences at the above locations are unknown.
TKSFVEQDITVVPFITRIAADETTNVDDCNTEDSPQIKGRKMFLRWYLTKLCSDPTEMEFWRYXNKVG

SEQ ID NO: 43229 - protein, 147 aa, A.fumigatus
PSIRVMHSGQERRLPLNIEYIHIGVMLGFIQDVFTEAFMSHPTLSLQRKVALVRAIGKIIWIQNDLFAKWRVRDGEEYADEMSEIILDDKEGYIGEKKILGDSSPSASSSDDDRSSIASSVAPSAASACPFSDMARPSSETKIWAGR

SEQ ID NO: 43230 - protein, 153 aa, A.fumigatus
LLWSCQVRGEDNPAYNASKAAIKNLTEHLAHDLRSDPATAHISVHLLIPGWTWTGLMGNVGPTDESSLKKMEGAWFPSQVAEELVKGMEKGSFYIVCPDNETDRALDQARMQWASDDVVEDRPALSRWEDTWKGRAEEWIQSEAKRRRDASNS

SEQ ID NO: 43231 - protein, 114 aa, A.fumigatus
YWWLCEIAYCWASVGCKVSVCIFLRRITVKRLHIWILYCVIALTAIAGLAFMLIMLLQCRPIEYFWTRTALDPSIPGSCIDIHIVIAMTYVYSAFAALCDFTVGILPIFVFTRG

SEQ ID NO: 43232 - protein, 187 aa, A.fumigatus
  UNSURE (7): Identity of amino acid sequences at the above locations are unknown.
APIRPVXVGEDVRWPDPSKKPVAPGTKPGLKLLASHPETIRAWPGGFGYAKLGANYGPSLSAHGQAQALGFDQVLWLFGEDRQVTEAGASNFFIIWENKDTGRLELVTAPLENQLILAGVTRRSVLELARSRLTKPVGSLAPVDVVEKALTIGDVELAWKEGRVVEAFVSGTAVSHSWLENAHSSFR

SEQ ID NO: 43233 - protein, 182 aa, A.fumigatus
  UNSURE (68),(99),(102): Identity of amino acid sequences at the above locations are unknown.
ERFHQNLKPLLNREPISTEEGLMIERMVNEMGKRWAEIARRLGNRSDNAVKNWWNGSMNRKRRGLSAXTTSPSRTFQGRVEAPYPRASTALGSPIDWPXFSXSHNRPLTSWTNSSIQTRRESSAASVDCPRQLSPIYTLPALNRPVETPLTSPSFSDVSPPSMVSDHNSVSSASPRTVASSV

SEQ ID NO: 43234 - protein, 77 aa, A.fumigatus
PDRPIRTFNTAVVYYHKFRLIHPDTEYNYMVVAPCLNLQWKYADVTGRMRLQLLYSRHARSRTPLRSPGRLYVLRTT

SEQ ID NO: 43235 - protein, 193 aa, A.fumigatus
  UNSURE (12),(13),(15): Identity of amino acid sequences at the above locations are unknown.
GAGLTHTATPAXXTXERHMVLGEPLTHAALVRDRNQDGSLSTVFVLTMHHSVCDRWSVGLIMDSVETAYTGQTLTTNSMGPFLQYIQQLQGGDAFWRSQFVGVKAEVFPSLPSPEYTPTPTETIDLSVELRDAVPGGHTIANAIRLAWALVISHYTSCSDVVFGVTISGRAVPVPDIERIIGPIIATVPLRVR

SEQ ID NO: 43236 - protein, 88 aa, A.fumigatus
SAGADGSVLWREEMRSCTMRLVRYMLKVRGPHMTLNLQRIDYVSDNEPYDAEKHLVLGTSESAETLAKLEYEWYTNDEAHTAAIYASR

SEQ ID NO: 43237 - protein, 142 aa, A.fumigatus
LSSSIQKAIANVHVHTMTERCHPVDDCSAEKMTSAPDTVKEAALLVVTEGQPNIQNVSEEEYTAMERRIRLKVDMRLCTIAGILCSLNLLDSGILSSASVTSMFEDLDLRGSRYSVSIFIFTIASVVAQLPCTVAVRVVGPR

SEQ ID NO: 43238 - protein, 75 aa, A.fumigatus
RLGTCSTIGKRTNTILGYSEVTLEWQIEDDYYNTGNPKSLQAGTYRFHYYGDAKNIQGQIKSFEGIGKPFTVNLG

SEQ ID NO: 43239 - protein, 88 aa, A.fumigatus
LRSSQLVLSNHSRLYHTLKTGAQLAEWAESTHSLSHTWNTRAENLKTAINQYCWDDAYGAFNDNATATSLHPQDANSMALLFGIVNET

SEQ ID NO: 43240 - protein, 95 aa, A.fumigatus
PLDLTFGRRGETTGAFDESGPPLSQKNSDTYHMWTMIGTYNYVLFSNDTDFLLTNWEKYQAAMDFIYGKVDEKSGLLIVTGTRDWARWQQGYNNS

SEQ ID NO: 43241 - protein, 235 aa, A.fumigatus
  UNSURE (23),(220),(224): Identity of amino acid sequences at the above locations are unknown.
VPGPTKLDHGNGTSMAVAKQASXWACPPTSKTQPTRATPRGFESPLYVIYSCAGERVTNSNKDGTSFWNGQNMERSELIPQTTANLGSGHLYYHFSLSTKTTNAPDASFEHQIAFFESHFTELKYGASGSSDNTLRWYANGQTHWSIQLEPGNWYNFAYDIDFASQKVGLWASNGSDPLTEVVSPVSASTFTNSADWHVGQLRLPNRGASNDAPEDWFWXGIWXLHDWKWKVSRS

SEQ ID NO: 43242 - protein, 122 aa, A.fumigatus
HVLGRMGSTSTSHSLKYRGEGQKPYSARNIGSMVAEAYRTLLYGGVFAYPADKKSTKGKLRILYECAPMAMLFENAGGLAINSRAERLLEVVPEHIHDRSGVFLGSKDEVQKIIDTYNKHKK

SEQ ID NO: 43243 - protein, 134 aa, A.fumigatus
LVCRLCCKKQMEHAADILNSNVAFGCNLGGTTSISCLVSQTDSTTTHVTATAMITDIGSFFLPVVVTGTATAGAHATTGASVTGATPSATGQTTLATSGPSVTSGPQATGSSASASATPSHSSQRKSLPSPNIT

SEQ ID NO: 43244 - protein, 91 aa, A.fumigatus
TRTFQPRGEDVWYQFEYPALTRDSAARSSPVLSILKVDPTLTDADGNFLDEGTVMWTPAHGPSPNAPLGDGYSFTYQGELARVCFRGNVLN

SEQ ID NO: 43245 - protein, 60 aa, A.fumigatus
  UNSURE (17),(29),(50),(53),(54): Identity of amino acid sequences at the above locations are unknown.
LLLFEIPARNSIGHGVXSSILEDRLNGIXAMARVSRGQLCSVTCKSVVRXGPXXVQAVQP

SEQ ID NO: 43246 - protein, 113 aa, A.fumigatus
SDCKYYTYQLNSLPLSSLLFRSISRLLPSKMETSLRDKVAIVSGSSSGIGAAIVRELSSRGANTVVNYPFPSLRAEADTLVASLPSPAIAVKADMSRADAPQKLVDAAVSQWG

SEQ ID NO: 43247 - protein, 270 aa, A.fumigatus
  UNSURE (181),(183),(204): Identity of amino acid sequences at the above locations are unknown.
RSTGGVLTFESFARDFRYSPADKTRVSSIAVGIQQAGALVGCFAVWPVTNRWGRRLAMMACSAVFCVGVILEVINAHSLALFYAGRVICGLGIGGSATVIPIYMAEMSPKESRARLGSCYQFTYTIGILVSYWIDYAVKFMPPSPAQWQIPIALQLVPGALMGLGTSTLPESVRWLLARGXHXRAHSSLLWIRASSPNSPALSXEFSHMRLGLEQERNRTANFHPRNSLAGPHARRLLLGFGLFLAQQSQAPPALPTLAQSFFPSGGNGQ

SEQ ID NO: 43248 - protein, 72 aa, A.fumigatus
  UNSURE (1),(2),(3),(4),(5),(6),(7),(8),(9),(10),(11): Identity of amino acid sequences at the above locations are unknown.
XXXXXXXXXXXKTADSFTKFFHLFIQKQLHRFDFPYILFPFLAHFFISSLRICCFAGQDSGAGLQASTPRGI

SEQ ID NO: 43249 - protein, 61 aa, A.fumigatus
GACSACAHPSAPVVKTGTPKVKGSSKFIAPLDTEHTPFHKYSVLRPFSVEADEQPLTVVVT

SEQ ID NO: 43250 - protein, 201 aa, A.fumigatus
  UNSURE (191),(192),(193),(194),(195),(196),(197),(198),(199),(200): Identity of amino acid sequences at the above locations are unknown.
GQVTENFGLNEVDLVNMPMADTPAALSTELLPYQRQGLAWMIEKECPQLPGPGSQNVVQLWKRAGNRFTNIATNYSTAIPPPLASGGILADDMGLGKTIQIISLILANPQPNTPESSKTTLIIAPVGVMSNWRNQIKDHTHSESTPSVLIYHGTGKKEAAKLDEYDVVITSYGALAVEYDPSAKAAPSLHXXXXXXXXXXK

SEQ ID NO: 43251 - protein, 289 aa, A.fumigatus
  UNSURE (5),(6),(279),(280),(281),(282),(283),(284),(285),(286),(287): Identity of amino acid sequences at the above locations are unknown.
VRGSXXPWIFGMVFLATDTKTGHDVAIKCLTKAPSDDPSAPSAIDDRFEELYCHKRLAHHPNIVNLIHSFETETHLYLVLEYCANGDLYEAIRLNRGPLETEHVRDFMLQLVSAVEFLHSNGMYHRDIKPENIFLTQDGTMKLGDFGLATHAPWCHEACVGSDRYMAPEQYDPGANGYSPAKADIWAIGICLLNVLFARNPFATPTESDILFADYVRDRQSLFDIFTNMSQDTFEILRIALAIDPEKRSLAGVRDALLRVVSFTTDDEVLDDFCTDGLXXXXXXXXXGV

SEQ ID NO: 43252 - protein, 203 aa, A.fumigatus
  UNSURE (36),(192),(193),(194),(195),(196),(197),(198),(199),(200),(201),(202): Identity of amino acid sequences at the above locations are unknown.
MQEPTWDYFSYVRSPMQAKQETELMSPENPAGPATXLVFALYNIGSIPAVVLSGPVNDYLGRRAGMFTGAVIIIIGTCIQAPSVNHGMFMAGRFILGFGVSFCCVSAPCYVSEMAHPAWRGTLTGLYNCTWYIGSIVASWVSYGCASIKSHVGFRIPIWCQLVSSVIVAVGVWFLPESPRWLMAQDRVESSXXXXXXXXXXXY

SEQ ID NO: 43253 - protein, 99 aa, A.fumigatus
LGNEHEVGQGIKDSGVPRENIFITSKLWNTHQPNVAEGLQKTLDALGTDYLDLYVNPHHSPLVRRGTAARSARLTLTSAHPLASPTSSCRPATPAVFHP

SEQ ID NO: 43254 - protein, 199 aa, A.fumigatus
VTVLSRPTISSDFCLKTSSLTTYIRLHPFARVAEWLFNEDVIKAIFATAQQDASEVANAASDSILIQCLVKSIEVMDLMLDLQSTYFHIVRPSIKSQAGGSRINVANSSLSSFEDSILNNLTIIPALSLYCGAGHEQLTVTSMALLEKMSSSRKLNKLSSPEISNWQSSNKIVEVLSTEVDVDTGSRPVFTKGGEGSAL

SEQ ID NO: 43255 - protein, 60 aa, A.fumigatus
DTSRDSRKQREEGACTSVTQTLIIDPTLIIYKVDHHWAAQDLFTTYNVCETSRLSLSIRR

SEQ ID NO: 43256 - protein, 63 aa, A.fumigatus
  UNSURE (32): Identity of amino acid sequences at the above locations are unknown.
LGSNILILRAMGKIQDTRASIKYRLREFSPYXIYGGRVVNLFNFSALLLQLRGNSIREFQAFC

SEQ ID NO: 43257 - protein, 68 aa, A.fumigatus
  UNSURE (57),(63),(64),(65),(66): Identity of amino acid sequences at the above locations are unknown.
KTNLEYQVHVRLFERAHKGGESGAYSIGPRSLELRPGTFKHAYIGDSLSFIVFTAGXHGLQFXXXXGP

SEQ ID NO: 43258 - protein, 92 aa, A.fumigatus
  UNSURE (87),(92): Identity of amino acid sequences at the above locations are unknown.
NYAGDISLYPAALTVRTIKAVFPSCRIFREDAAADAKLDFTNMVIFCKKSNTPLRFRDPVKADFLGSKSRQHYLVPKHESSPRGWKXALHYX

SEQ ID NO: 43259 - protein, 121 aa, A.fumigatus
LDFLSGLGVGTTPAALITHGIETTIVEIDPVVHKFAMEYFHLPSSHIAAIEDASVFVKRAQESPNPAQYDYIVHDVFTGGAEPVELFTIEFIKGLYDLLKEDGVIAIVRPAPPLLTPSPHD

SEQ ID NO: 43260 - protein, 133 aa, A.fumigatus
LPRPHKSATGLAPGTPTHILGPRERPDTRPRPRPPARLLFTRGLCKQIMLSFSSPRFPGLALLFSRSSLLPSEPPPPQPSTHSVQTIFSCLSSLPPPSPPPPPPPPLHPHLPPPSNPPLLLPRFTALKISPPA

SEQ ID NO: 43261 - protein, 164 aa, A.fumigatus
PPSSPPRAATPRSSPPPPPLGTHRASVPSIVRRQSTPGHFDPAGPSRLAGAPPPPPPLAPPPPPAPPRRPPHHPCRPLGLAAAPSPARPSPGTQVRPSLFPGQHFSPPRPPPHSPPPPPPPTAPPPLPRPPPTADLSQNQPFRPPPPPPPPPPPSPPPHPPPPP

SEQ ID NO: 43262 - protein, 174 aa, A.fumigatus
STDTEPRKCNPPPLPHAPPPPAPPPPPPLWGPTERAYLRSSGDSPHQVISTPLGPVGSLAPPPPPLPSPPPPPPPPRAAPPITRADPLDSQRRPPPPGLRQEPKCAPPCSLDSISPPRDPPPTPPPPRPPPPPRPPSPAPPPLRTFPRINLSAPPPPRPPPRPPPPPPTPPPPP

SEQ ID NO: 43263 - protein, 183 aa, A.fumigatus
GGGGGVGGGGGGRGGGRGGGGAERLILGKVRSGGGAGEGGRGGGGGRGGGGVGGGSRGGEMLSREQGGAHLGSWRRPGGGGRRCESKGSARVMGGAARGGGGGGGGEGRGGGGGASEPTGPSGVEMTWCGLSPDDRRYARSVGPQRGGGGGGAGGGGAWGRGGGLHFLGSVSVDQRQWPLLQL

SEQ ID NO: 43264 - protein, 173 aa, A.fumigatus
GGGGGGGGGGRGAGGGAGGGGGGKVDSGKGPQWGGGGGGGAGRWGGAGGGGSGGGVAGGRNAVQGTGRGALGFLAKAGRGRAPLRVQGVGTGDGGGGAGGRGGGGGRGEGGGGGRQRAYWAQRGRNDLVWTVAGRSKVRSLGGSPEGGGGGRSGGWRRVGERRGVTFSRLGVC

SEQ ID NO: 43265 - protein, 115 aa, A.fumigatus
HPDGGCQPGTTPLLPADLSHWTNALSFQVWSVPEAIEWMHQLAEFKPWFIEEPTSPDDILGHAAIKKALENTPHGTIGVATGEMCQNRVVFKQLLQTGALTVLQFSTRRSKERCN

SEQ ID NO: 43266 - protein, 67 aa, A.fumigatus
GYSEDKLRALLKESVAQGYKHFKLKVGANVEEDRRRLTIAREAIGYDRGNILMVDANQVRLHSFLLI

SEQ ID NO: 43267 - protein, 67 aa, A.fumigatus
FTPDDSNRSISLVYGDSNHSKNTYDNQGLPRFWMDNSMYFLCEYTPTLFFCSYGPDIMYEFSISLSI

SEQ ID NO: 43268 - protein, 128 aa, A.fumigatus
GAFDALPPLVKTLTYVLGGISEIFASVTSLEYAFTKAPKNMRSLVQAVALFMNAFSSALGQALVSLSEDPLLVWNYTVVAILAFVGGIGFWLTNYKLDKQEDALNNLPASRYGGDNPDPKLDEESVRQ

SEQ ID NO: 43269 - protein, 131 aa, A.fumigatus
TQMRSLQPPVKTRMIYYRRNMSSNAMLPIRKSNPTPQAMYTIPPSPKTLPAPYSAAALRASAPYSPARCSSLSSKRPSPAARYTPPASTDATQASAGGRRSPGAISRHSCTKHTTALAISPTHLRQSVREE

SEQ ID NO: 43270 - protein, 86 aa, A.fumigatus
LRNDIISFDQNRKRIVSTFWTFDHITYLKSAFDLIHRSNNRNTQVYKMIGSLFFIFNRLVEIVFLIPIIGMMVSIYTCLAYAFPGS

SEQ ID NO: 43271 - protein, 162 aa, A.fumigatus
LVGTVSGTYWATCTPVAAEILGLRDLPSGLSITWLMLVPPTTVSEAIALLLRDNKSADSKYLKVQIFTGFMYIGSALCLWLVRGWKVGDLARAKEEAVAAVDTRQAGDCAAGSAPSAGVAEDAETEKQGQTVDPAFSMHTASNRNPWTPATLLRGMVALKRV

SEQ ID NO: 43272 - protein, 113 aa, A.fumigatus
RLLAIQEKGVSAWEFQPELEIANCFVEGRTEIEFYDSECSVQTNLPVPKQNDVYYWEAKIYEKPESTLISIGMTTKPYPLFRLPGMSMSEYSTLVLLHSCCCSCCCSCCCSCC

SEQ ID NO: 43273 - protein, 96 aa, A.fumigatus
FSCTPVAAPVAAPVAAPVANTISPFTGFHKTSVAYLSTGHRRYNQPFSASPYGPALAQGDVVGVGYRPRSGTIFFTRNGKKLEDVVHGAKTQNFFP

SEQ ID NO: 43274 - protein, 80 aa, A.fumigatus
  UNSURE (64): Identity of amino acid sequences at the above locations are unknown.
HTVPSDSWEMIIGGYPVRYVVRFGKQGYQMKIYGHKDPRQDTESVLLIHAINSGWLFLVLNRFXMSSFFTSGSAGPRLVN

SEQ ID NO: 43275 - protein, 146 aa, A.fumigatus
MSRDGTYGIPSPQFQATPSSHVSSPSHTKSPGFAFQGAMSPNGMDAQQAQHARSQLNLHSRNMSQTSPPISIGQPESTDPKSAVSGGPGPRVSRVPSAAYYPSPFQKHYDQLGKLTFVTVALPFFFIVFLTEVISCTHTFPCRTGI

SEQ ID NO: 43276 - protein, 70 aa, A.fumigatus
FRVLILSPVEQEYDAQADMIDEEHESVDAPPYVSGFNAATTSVPPGSHSLGPQLANFNVFTRGYRAALGL

SEQ ID NO: 43277 - protein, 77 aa, A.fumigatus
SINMSDNNNNASTLNSYINQATGLAQRAMGSVTGNPSTQVCTDPIPLRYTTYNPLTTSQAKGESTHTQGKAEYAASH

SEQ ID NO: 43278 - protein, 152 aa, A.fumigatus
YAMRGCFRLAVVKTDSPAQAITDSPANPQADFGPTIRGPLGWIVHARSGDKGPDANCGFWVRHHDEYLWLRSLLSAPKAKELLGEAYNANPELQIERFELPNLRAVHFLFRNLLDRGVGITTTVDFLGKNVAEYLRARWVDLPVKFLNRGKL

SEQ ID NO: 43279 - protein, 65 aa, A.fumigatus
TFDIRKCDNPSHLLYVFPDAQQQWHAKISNGKQPYRKAEPTHSTQRTKTKKTRKYTYAQHPDAMH

SEQ ID NO: 43280 - protein, 287 aa, A.fumigatus
  UNSURE (287): Identity of amino acid sequences at the above locations are unknown.
GWVLGYGGTLNIWVFWLQIARIVPCQRQETFGEAVSKSLKLLPLNWAVGYGTGLVSGVLGTDSLSLAGLDVNMTFGLAKNASTDFESYPVDGILGLGRSANSNFNTPSFMETVATQRLLKSNIIGFSFSRNSDGARDGAANFGDLDTTRFTGDIVYTNTTGDSNNWRIPLDDASVNGTPCRFVNKTAVIDTGTSYAMLPPKDATVLHNLIPGAVTTSHGQNFTLPCNSTAVVQVSFSGLSYNISPKHYVGPAYGSACLSTIVGQALYGDDVWLLGDVFTRGGQGAPX

SEQ ID NO: 43281 - protein, 174 aa, A.fumigatus
  UNSURE (165): Identity of amino acid sequences at the above locations are unknown.
RRRSPGSHATRKSRLLSADVLQKPDNRKNQNHPLRCIASSPSSPNPSTNSATTSTASPTPPPPSYKTSSPTASATSNSAPSPAPRPPSPSPEQNTSPPSSPPSKRFCRLTPPKSQSTSSSPSTAATTPPPTPSPSSTWPLRTAPASSASISAATPRKATSRCTVXPSPKPRPTA

SEQ ID NO: 43282 - protein, 231 aa, A.fumigatus
  UNSURE (127),(173),(202),(213),(219),(224): Identity of amino acid sequences at the above locations are unknown.
LLLRLLQIHLPTLQRPRQPRLRHLLRPTRLPRRRRPLPRTPHHPPRLAHPRLHPNRIPHHRPHHHRNVFVGSLLPNLSLPHPRHRPRQRHRRRRPLHRRPGHCAPPPRRRRRYLRQPHERRRRAVRXRPRQSQGPRPRHHRALRRERGSGSERELSTLLSFRAGRLGHVIHVXEDFKREIARRALGLELCMSCYVHAEMIDXGCPAHHFGYWXACGLSXGLVCXFPPPLFN

SEQ ID NO: 43283 - protein, 167 aa, A.fumigatus
  UNSURE (140): Identity of amino acid sequences at the above locations are unknown.
QPEEPEPPTKMHSFFSVFSKSIYQLCNDLDSLAYATSSVLQDFLADGVRYLELRTIPRASPTLAFTRTEYLTTVLTTIETFLSAHSSQISVYLILAIDRGNDTAADALSIVDLAIAHRPRVVGVDICGNPTKGDVALYGXALAKAKAHGLGITVHFAENEAPARSGN

SEQ ID NO: 43284 - protein, 115 aa, A.fumigatus
RGFFHPRGRMSADKSNLKEYYQPVTIRIYSSNPKILEPLARVVKPADEVRKYMNEVMDRAERAPEGFLALRLPRENKDEHEPEDTRKSGTPAPAANSGARSRFLKSNAAGGGENF

SEQ ID NO: 43285 - protein, 139 aa, A.fumigatus
ELYRPSESNMLFDAPSLVLYMCGITVYIANIVKGLRLASAGKYGEELATSPEEKDQILNREDSLKVLSASNTILALVLVGVLVLQAGQWYAERKDAQEYESLRKGHKEGGGGGASSSSASGAAAAAKPGRQGSVKKKSN

SEQ ID NO: 43286 - protein, 168 aa, A.fumigatus
KTRKCPAAISRNFHSLTMGRFGGFEYGYQQGVLGQSLVMTRFTENFSSVVHSSAATGWLTSVLQLGGIVGSLSAGIFGEIFSRKYTMFAACCWVILGSYLYVGASAGMASLLYVWTNLYRSGSRSFQRCWPLVQCLTGCSGDARSPGILLSIRDHPEDHDFLLGGLWQ

SEQ ID NO: 43287 - protein, 76 aa, A.fumigatus
DFFVSPGDPAFYLHHAAIDRVFWTWQNQDPKSRTYVVAGQTILPSLVPDAPNATLDDIVDMGSALAPPQTIRQLLD

SEQ ID NO: 43288 - protein, 79 aa, A.fumigatus
  UNSURE (67),(72),(76): Identity of amino acid sequences at the above locations are unknown.
CFLFACLAIATWDNLSISSLTSYASWLPLKSQDMYSSYTLLKQRTTNSPGDMCPMNSYSHATSLHFXTDWTXTYFXGPD

SEQ ID NO: 43289 - protein, 73 aa, A.fumigatus
  UNSURE (71): Identity of amino acid sequences at the above locations are unknown.
IASIIKWSLVQNSRSVYTVSSLLLYTLSMQLLDISKRDVSSWFFDREACKRSLRGLVQSSPGVQERSVSKXPA

SEQ ID NO: 43290 - protein, 186 aa, A.fumigatus
LEANLPRRLVFDLLELYFTSAFSTHMHPVCHHIHCYVLRKASFLSRENPRPSSPALLASMLWVAALDDRAFALSISPPQRKKICQFLCALTIRLLRPLIHVSFKEQAGSNASDPTFTGVAPECPPTTVHHPFESSGDDRGLVGPAGSLDDVITYIHVASIISSSEQKAASMRWFVLSPFRGCRRRD

SEQ ID NO: 43291 - protein, 65 aa, A.fumigatus
ISFLFYFVLFYFIFIFILFFIFIFIFIFIFIFIFIFIFIFIFIFIFISDRFCFLVSKTYSMYFYQ

SEQ ID NO: 43292 - protein, 76 aa, A.fumigatus
  UNSURE (75): Identity of amino acid sequences at the above locations are unknown.
SIEGTPARITSALQLHPTRHLNVFYLLLFDYIISSITTTITALFSIMLKPGVASIVPSIYFTKGRKVRACGNPSXS

SEQ ID NO: 43293 - protein, 223 aa, A.fumigatus
  UNSURE (87),(89),(91),(92),(94),(95),(211),(221): Identity of amino acid sequences at the above locations are unknown.
TSSLKIILLPRNKVQDRIVGKTPPRNTTEGGVWGALHDGSAIQQIGTQWLVLIMLLAVLQMLRIKYFVASIRAQYDYLLSPALSKQXNXVXXVXXPLGGLLSVPFIGTILDTLKTQHVLLILVSTATVIGILGCIPHSLPAGYANIALFVIYRPFYYTAVSDYAAKVFGFQTFGKVYGLIICLAGLGNFLQAGLDALTFKLFARDRLHPGXKIARHQFKIXAG

SEQ ID NO: 43294 - protein, 81 aa, A.fumigatus
  UNSURE (75): Identity of amino acid sequences at the above locations are unknown.
AYNPPRFMASEADLDTEIKGLSILSEHPELYAEFAKLGCVGSLTSLLSHENADIAIDAIQIISELTDKDVGTSHXVVGDSV

SEQ ID NO: 43295 - protein, 150 aa, A.fumigatus
  UNSURE (31),(106): Identity of amino acid sequences at the above locations are unknown.
KVNNTRYNSPGVPRLGLPAYNWWSEALHGVXGSPGVEFADSGPFSYATSFPQPILLGATFDDDLIKQVATVVSTEGRAFGNAGRSGLDFWTPNINPFRDARWGRGXDTPGEYPLHVSRYVYHLVDGLQNGIGPANPKVVATCKPFAAYDL

SEQ ID NO: 43296 - protein, 131 aa, A.fumigatus
VGSACPSSPVVKTDRSVAVALGRPIGINTDDSDVGMLTEDDFIEDEIDSVAEYPPDPVHVQFFLQYVKLCEIMGLVLSQQYSVASKSRRMNAMDLTHSDMALADWLQNCPKEVCWQKSRHHFLAALLHANY

SEQ ID NO: 43297 - protein, 70 aa, A.fumigatus
  UNSURE (18),(53),(56),(60): Identity of amino acid sequences at the above locations are unknown.
LSNSVYSLFSALIMHVYXMRSSVPSIVTTCQEKINICMPGLERLVQRFGLVAXNGXQLVXSRILGQQIPP

SEQ ID NO: 43298 - protein, 221 aa, A.fumigatus
  UNSURE (170),(175),(199): Identity of amino acid sequences at the above locations are unknown.
GRDRQRRRVPSRPCTRTVLSSVRQAVRNHGSSAVSTILCGVQVSEDERHGLDAFRYGSSRLASELPKGGMLAEVPASLLGSSSSCELLVSAERTCHLWKTMTNEPSTTLCLLHRAHMPPASSAPNSYRVEEMAYPSRTIAFQAAGMITSIVENLQTHQEIRYAPAFMLVXPFKDXYYLLLTFQQRLQLVLGVDHARLPXAVISTIYCYDVPGKNQHLHARP

SEQ ID NO: 43299 - protein, 95 aa, A.fumigatus
RGCPSSRVVRTADSFRIESLIPAELASLPSTADGISQFMTKLPSFDSQMAAIKEGAEKQGKVVRYVGSVDVAKKGGSRWATTVRQGQCYCGTQGQ

SEQ ID NO: 43300 - protein, 68 aa, A.fumigatus
QRKEVRVGLQQFDKDSAIAGLKGSDNIISFYTKRYGSNPLIVQGAGAGGEVTAMGVTADLIKVIQRLG

SEQ ID NO: 43301 - protein, 92 aa, A.fumigatus
  UNSURE (5),(6),(7),(9),(10),(13),(14),(16),(17),(18),(22),(27): Identity of amino acid sequences at the above locations are unknown.
LRRKXXXPXXEEXXGXXXKALXNQLNXWPHSQSDAVCSGPNRPPRQKPNRGTPVGMYFMAPFLLGSVKKIMGGTIVWRPPKILRGESGCFPF

SEQ ID NO: 43302 - protein, 87 aa, A.fumigatus
RLHRSRMSIATPINLILLSLFAILVYMQLRPKAPVALPQAPPPVVFRTFTPTTLLEYNGECDKPVYLAVRGRVFDVTPGKNFYGPVC

SEQ ID NO: 43303 - protein, 137 aa, A.fumigatus
  UNSURE (19),(106),(128): Identity of amino acid sequences at the above locations are unknown.
KRGERGRKWRERSREETEXRQGRDRERPGQTSEDDRNRERRQREDEHRRRRRGGRGEPARRKEKRRQEDKRERKRNKGGGAKKAGRGREKREGAKKEKQTRGGRAXGRRGAGGAPPPPPLLVSFLIFXRKPLWTITR

SEQ ID NO: 43304 - protein, 138 aa, A.fumigatus
DNRSIFHSHPLITPQIQLSESINSTYQFKMSASVPAPDANQDYKASLLTLLISNNVLSYGTYTLKSGRESPYFFTSSLLHTAPLLRATSAAYASVLSAEPFVKTANDGTLRHKFDIHLRVLSSLGASLSRDMKQYYRV

SEQ ID NO: 43305 - protein, 112 aa, A.fumigatus
VSSCGYTFLWNLLDYSAGVLPVSHVDPKKDALSAPYKTVLKQLGANHAIARGAWKHYDAAKMAGLPTAVQVVGRRWQEEKVLGYMAVVEQALEGYYDKETGEGGKYPLLEID

SEQ ID NO: 43306 - protein, 178 aa, A.fumigatus
DDENSDDGQDDVQASLSNISFGALAKAQASLGPTAKRKSKATQSKTDDGETPAASPLDDIRARIREAREQKREGSSKSKDLEKFSRSSKHAPMVQSSKHPVTRKRTIIEPPAALKSRDPRFDPAVRSQSGRSEASQSAYAFLDDYRAAELKEMKEKLAKNKDPRQKEALKRDIRSATD

SEQ ID NO: 43307 - protein, 109 aa, A.fumigatus
  UNSURE (29): Identity of amino acid sequences at the above locations are unknown.
TILSTLVYIINPMRYYKINLFTPQAAGLXISTTPFQPRGEDSSFFFFDFEALDFFSFSGLRSFFLLGVSSKAPVSASAVLGAAEDKPANAPDIVLEGSHWPCGRGVIEE

SEQ ID NO: 43308 - protein, 138 aa, A.fumigatus
GFPAAEGYFQSVSGHRVRGTVRFRVVDIDVIPGSDRERGFLSIEGTMLSPEEEARVLDDERNGNYSSMTPRPQGQWEPSSTMSGALAGLSSAAPSTADADTGALEETPSKKKERKPEKEKKSKASKSKKKKEESSPRG

SEQ ID NO: 43309 - protein, 222 aa, A.fumigatus
QLWVDLPKELKMCEPRYRDLRASEIPVVEVDDGRVTVKVISGQSHGVDSVRDVAYTPVWLLDMTIRPGGRISQPLPEGWNAFAYTLAGTTIFGSNDATRVVKEFHNVVFDQAGGYVEASVPDNAESESRFILVAGQPLDQKVVQYGPFVLTSQEEVYQAMLDYQTASNGVHHGAGRYRAATLVRPGLTAGRPRARREENVGRTTTTETPMPRVHKKWDAQGT

SEQ ID NO: 43310 - protein, 132 aa, A.fumigatus
  UNSURE (127),(128): Identity of amino acid sequences at the above locations are unknown.
APLSMPRSSATARKSHSNRHENGSANTGKKVAKQRSNGHLNGNLNGGSASTSLSSSQVDLPSSRSSSDPVVPTTTAASTKLNGTPDSSKGDCNAPDHLNGYAKGNADMSYVQNDGVASQTGGDVAGXXFAFY

SEQ ID NO: 43311 - protein, 179 aa, A.fumigatus
  UNSURE (29): Identity of amino acid sequences at the above locations are unknown.
INKTVYERAMNAWSKPGGCKDLIVKCREXAAEGDPTMSGHNETVNEACRRANDYCSNQVEGPYILFSKRGYYDIAHFDPDPFPPPYFQGFLNQNWVQAALGVPVNFSISVDSTYSAFASTGDYPRADVHGYLEDLAYVLDSGIKVALVYGDRDYACPWNGGEEVSLRVFDHWGSEGSDA

SEQ ID NO: 43312 - protein, 134 aa, A.fumigatus
VGAIGNEIRNGLLWPLGKPDNYANIANILHSAAFGVKDSTLSPKPKIMIHLDNGWDWSAQKFFYDRVLSSGANLVKSDFDLIGVSYYPFYNPSATLSALTTSLKNLRSTYGKDVLVVETDWPVSCPNPAYAFRL

SEQ ID NO: 43313 - protein, 236 aa, A.fumigatus
  UNSURE (222): Identity of amino acid sequences at the above locations are unknown.
RLMEEYARVIHFYRNGGNFYRTYQPDGVPLELVAYTQTLQSRLELWKSAFGYSYSCQKAQGSPQTSARASLLLIQYYIALVTVSTSVYAEETLYDRFLDAFKRILSLVRTSNACCQSTVATSLVGVPIKMGVIYPLYFVATKCRDSAVRQEAIDLLSSAPCPDVVWEAPILTAVSPRAKEIEELGLDENEPIPEFKKLHGLGWGIDYETRQVSVQFRRTTNXMDREWDQLKECLTW

SEQ ID NO: 43314 - protein, 143 aa, A.fumigatus
VQYDFDSCIMGNTTSIAAGRDCLLSAVGGNHAHVAFQDQLLYQATAVEPYNVNIPVTPAAVTYPQSADEVAAVVKCAADYGYKVQARSGGHSFGNYGMYALNCYGGSSQPPKSSPLTCLCSRPRRRGRGHRGRHEALRPILHG

SEQ ID NO: 43315 - protein, 81 aa, A.fumigatus
LVSVQGLGGEDGAIVVDMKHFDQFSMDESTYTATIGPGITLGDLDTALYNAGHRAMAHGICPTIRTGGHLSIIRHEVKDPG

SEQ ID NO: 43316 - protein, 94 aa, A.fumigatus
  UNSURE (23),(82): Identity of amino acid sequences at the above locations are unknown.
TTLSVSPGATGRPTTLTTTTAAXTTSQTTTKPTTSGPIHPQPTVTASGNPFSGYQLYANPYYSSEVHTLAMPSLPSSLQPKXSAVAEVPSFVWL

SEQ ID NO: 43317 - protein, 125 aa, A.fumigatus
  UNSURE (125): Identity of amino acid sequences at the above locations are unknown.
DQLSDSRSDVAAKVPTMGTYLADIQAKNKAGANPPIAGIFVVYDLPDRDCAALASNGEYSIANNGVANYKAYIDAIRAQLVKYSDVHTILVIGRPYTSVARRLSLTSCRTRQLGQPFSHTGLEGX

SEQ ID NO: 43318 - protein, 103 aa, A.fumigatus
  UNSURE (48),(95): Identity of amino acid sequences at the above locations are unknown.
KRGTIRPVETGRSNWWHLLPTLIQTPWAPYIGRTKRILVAPPCLAASXYRTLGRVIWKLDAEPASVIGVRWLTKIFVAGDVISFLLQCGGNRHHXVLSVPDTH

SEQ ID NO: 43319 - protein, 152 aa, A.fumigatus
YTTGGGYMAAGTLEAMKNGEHIVIAGLAIQLLWFGFFIVVASLFHWRVVRHPKYTISNDLRSQGSGISWSTLMWALYAACVLILVRSIFRVVEFVQGNAGFIMRHEYLLYVFDAVLMALTGIVLGLVFPGSFVSRRSRCADDAVPLGSQLSR

SEQ ID NO: 43320 - protein, 110 aa, A.fumigatus
  UNSURE (5),(11),(13): Identity of amino acid sequences at the above locations are unknown.
LSRSXPSCGKXPXVARYMPHVRKAREEDLKEGKITRQEYDAIESLERNHIRYGSIADSESDAYERNSNISTAHSNIGYLFTLALNLSVLLPLQNNTYSNNLALCLTNSCK

SEQ ID NO: 43321 - protein, 74 aa, A.fumigatus
  UNSURE (16): Identity of amino acid sequences at the above locations are unknown.
RLLDWVVLGVWWFIFXQKRPGPQVPKGSNYATIGFKQIWLALREVRSLPQTFLYFIAYFLLADGLNTTGECSQP

SEQ ID NO: 43322 - protein, 172 aa, A.fumigatus
  UNSURE (4): Identity of amino acid sequences at the above locations are unknown.
VTLXSFDPGLVKTAPPPRRTYQDPAHPELTQIMLEDESGRLRLTGSLLTSTQLATGVIIAVLGTENANGDFETIDIRVPDLPPQPRRWERNENRTETKEPRKSKIAFVSGLGITGTSSDTLALELLADYLLGYTGSDASSITRLIIAGNSLGANVTAEAAATDMEMGTAAKK

SEQ ID NO: 43323 - protein, 127 aa, A.fumigatus
  UNSURE (5): Identity of amino acid sequences at the above locations are unknown.
YCTTXTNNHQPPTSFKLYAAHILSMLSMQKTPTFILPPTANLNNHNPHGIQSNPTAEHRNSTRALSLSEIPAFPDGPSMGDGLSRHESISTDGTSNDSPESWDGESHSDSCPSVDYEIKIHDGSYPV

SEQ ID NO: 43324 - protein, 169 aa, A.fumigatus
  UNSURE (166): Identity of amino acid sequences at the above locations are unknown.
TANASSLLATLNLRPGPEAQKSYRYYLCRFNWWRYSATSIFKPLFTYLPVQNSANVVNSAAMSRHHPDLVMCRKQPGISIGRLCDKCDGKCPVCDSYVRPTTLVRICDECSFGNYQNKCIVCGGEGISDAFYCFECTRLEKDRERCPKIINLGSSRTDLFYQKKSXRNH

SEQ ID NO: 43325 - protein, 64 aa, A.fumigatus
KVTSLVKLLNNILTISYPAQCTQKNPRSYFSISSGPVSISNIMARLYICYHIFTTTDKVRIMLK

SEQ ID NO: 43326 - protein, 159 aa, A.fumigatus
  UNSURE (143),(144): Identity of amino acid sequences at the above locations are unknown.
KNSAPRQSSSSTRRSKSKSKSTDKPAYEVEYVPRTHQLIESRPSSTLTPTSTSTTSTSTSTSLSRRLSIRLTPRSRCSRSYCDTTERQPLVKRRAQFAYKPIHQDYLSEVAKKTAAAPRITSNSVGERPISPSPTPPSSLEAXXSPSWSRFRYIPARPQ

SEQ ID NO: 43327 - protein, 271 aa, A.fumigatus
FPTAWRKTGGESHSGNGARTASFDRESGTENMFEASMDVLDVEAQGHTAWMTSALLEFYCVSKATDILNAREGSQMRYTRDSPEVQHLAKKMYAHQSQLLSTHGMLPGGIESDECEERRQRYRETIDGIGLQALKGLNLDDIPKQTPSLDATKDVVLASKASNRMQVHVKTDFARPAQMRRQYSGLLGFREQDAGRGDAHAPEHQPFALLGSSPVSFPLFRPNPPPPTPAISRYATEFSEVRVLGRGSFGEVYHVKNHIHGQNYAIYWTTG

SEQ ID NO: 43328 - protein, 100 aa, A.fumigatus
VAAFNAFIGTTVIVAQISFAVPAALLIYRRRSHEYLPPSRPFKVMHVVGYVCNVMTVVWAVVITIFSTFPTTFPVTGGNMSMSSFLPPRFRYGFICCGCG

SEQ ID NO: 43329 - protein, 63 aa, A.fumigatus
  UNSURE (1),(39),(40): Identity of amino acid sequences at the above locations are unknown.
XGHGGCKHGEKNDRRRPGEMAQNDWRRKPDEINNTVNVXXNETHPMNGKTAPRTKRPSRAIKL

SEQ ID NO: 43330 - protein, 79 aa, A.fumigatus
SSEHPHNTTDVVSNWRRLYKYVVRCIIKCSRRPAVEHPAETETHPSDQITTNDIWHFNNGAVSLVSSMCHSVSHCAQHF

SEQ ID NO: 43331 - protein, 172 aa, A.fumigatus
  UNSURE (14),(108): Identity of amino acid sequences at the above locations are unknown.
NGAYNQGGYFMANXYPPQYFQAPNSQQQQQQPQQPQQHNLASLQPTYQTRMAYNANDGTNGLIQQFSNQDLNSTRTGFFGRAASPAQRPRTAGFSAPGQQQPGHLAPXMPRSPRTPAENEELQRYPERYSENVHKRGKAAKELVNVFFHENIERARDRNMRLAPAGLERPAL

SEQ ID NO: 43332 - protein, 90 aa, A.fumigatus
RVQWDSNSLWESRYIWLPMDIDENKKTLDLVWNDVYDLNVYVVHQLFKEILTGPAKPGSGKPSAARHTLPKRPRRTAMRINRKLYVLHRR

SEQ ID NO: 43333 - protein, 114 aa, A.fumigatus
IGPKSPYLFLSLISSFKFSLPFQPATLLILEMAEDKAPRPTMDPKLEKHAHDADEAMKAFEGMEGESITLDEETNKRLLKIIDWHMMPIMCVVYGMNYLDSIGQRIIREHSNKN

SEQ ID NO: 43334 - protein, 100 aa, A.fumigatus
TAVWMNYQSITMAASAPDNGHRSHPSQQAGSTIPRSSEGHEERSPGYRDEDFGAELEMERSSRTSPQSFTPRSLFVGLVIGALITFSNTYFGLQTGWIST

SEQ ID NO: 43335 - protein, 100 aa, A.fumigatus
EPDPLRAVQIGLDMDIVTSSHPGDVMAAAGIEHRTFNALPQDMLRAVPGVTPKVLERLILETGNISEIANMDVEQLDPLIGREAARKIVGFFRKNLFDSS

SEQ ID NO: 43336 - protein, 196 aa, A.fumigatus
  UNSURE (3),(196): Identity of amino acid sequences at the above locations are unknown.
SLXSKNMRTKLVDALNLWFQLPHHLVDTVKGTVDDLHNSTLILDDIQDSSYLRRGFAATHHVFGSAQCINSATYLLVQAASRLSVHNEQYPAVITVFLDGLKELSLGQSWDLNWRSTGYCPSTEEYMAMVDGKTGVMFDMIVRMMHCFSSSQTVPVSELSQLTQLLGRWYQVRDDYQNLHDEQPSPQRRRTAQSPX

SEQ ID NO: 43337 - protein, 154 aa, A.fumigatus
VGGGVLSDCFKPEERGKSVAIYSLAPILGPAVGPIVGGFISQDTTWRWVFYATSIADGAIQIGGLFFIRETYAPKILKRRAERIRKETGDSAYQTETERQNKTLSQTMQTALVRPFRILSTQPIVQVLAMYMAFIYGALYVPLLTIRPRAPKYA

SEQ ID NO: 43338 - protein, 116 aa, A.fumigatus
YYAPGGQLVHPRGVVSNETERAKANSKVTEELTHALVHKGFMVDFAPPSGDEDAAGDGKFFRCVVNVQTTRETVEALVRAIEEAGPAIIERLKAEAASVPKRRPGERGHGPVVHQG

SEQ ID NO: 43339 - protein, 81 aa, A.fumigatus
AGSFWIDFLFIYLCTICLTAQFRLFAAASPNFEVALRYSGVSVLFCIVFGGYVLSVDKMMNYVPWVGWIAVSTIRNNLSGR

SEQ ID NO: 43340 - protein, 75 aa, A.fumigatus
YTTPALYTYEAMMAAEFHDTKFSCAPGAVIPSGYTYNNIAYQTCGISGSQPGTTMVDGDHYLAVHCPPPGWKVKR

SEQ ID NO: 43341 - protein, 141 aa, A.fumigatus
LRAFDPPWKNTNAPRATNGTAEYDYIVVGSGPGGGPLAARLAIAGFKVLLLDAGDDQGDALQQQVPALQLQSTEYEPMIWDYFVNHYSDLERQKQDSKMTYRTPAGELYVGQNPPANSEPLGILYPRAGTLGGCSAHNALM

SEQ ID NO: 43342 - protein, 171 aa, A.fumigatus
NSCAYPASPVVEDEIPAGGTKSSPSDTGTELVSSFKAAPSPGSNIIIDGDLIIDMGSPPPSRPAYRVNPAHFSSNNTPGNEEDDDEEEEEEEEEEEMEALRLPSPVGHGGASSERVETAPPTQEEIEDDDDALAAEMEAAFEEEARKQEYQPPSLQYHVPSEDESEVSEEE

SEQ ID NO: 43343 - protein, 173 aa, A.fumigatus
YSYPSTRRLRQHGAPELRQPRMPLSPSTMSTTSVLDGFSLLPMTPPDLVDGVPSMHQDTAAVTTAIHVISTERAALANLEQIYQTDRLAQENLARAVSRIVRTVRNGGKLVVCGVGKSGKIGQKLEATMNSMGIYSAFLHPTEALHGDLGMIRPVRIFAAFLQSLVGESGIVY

SEQ ID NO: 43344 - protein, 69 aa, A.fumigatus
  UNSURE (25): Identity of amino acid sequences at the above locations are unknown.
LNGLRYFVPVMLHKCPTLAFLGQGXLLELNSQYSTSTTEPRVQSSHLGLVHKPSMISYVLTMNCNGAHG

SEQ ID NO: 43345 - protein, 143 aa, A.fumigatus
HITLSKMGSCFSTESPEDAEQKKRSQAIDRRLEEDSRRLRRECKILLLGQFWISLSIIMVIVPWANGSFPLICDRVRREREIYNCQANENHSSKRLHSGGTCVISFNDLQKSPRLRQSSHWSLPPIQPPTNESQSPRIHRVPF

SEQ ID NO: 43346 - protein, 109 aa, A.fumigatus
FATGSGESGKSTIVKQMKIIHQNGYTVEELALYRLTIYKNLLDCAKALIGAYHQFNLQPTSPKVREFIECLSEYNIDPDPNTPLDPPIGNAVTYLWNDPCTSTGVRTTE

SEQ ID NO: 43347 - protein, 163 aa, A.fumigatus
RVPATISKSANSRKKRTGKVQTEVSKTTAKKPQSSRSKSQAKGKEAKPKSSVRLPKVKTAKTKVKAAILPKKKSSKITGKSPSKPKVSPASSSTLSRPSAKAKEKILRVAKGANARKQTTKGKTAGTKSPCKNPTSNSIKKRPGAASSTKRTKGASVEMVHST

SEQ ID NO: 43348 - protein, 64 aa, A.fumigatus
TTGNAIALEGTDGHRCGGPTAGSSGGYATNTTSNTRENAAQFTLDASFAGRAKDLSLRSLDGLG

SEQ ID NO: 43349 - protein, 186 aa, A.fumigatus
EALVLPAPVAEELTTAVSTTAAGNGSLTSGCLYQPGATSVSQVNSSWAQSSSIPIINSSDETKALRAICDLVVNSRDCGLSPVLSNTLFNKTADSDAEPYQNISTSASWSWAIGEPRDPSPPGIDEDSQHIERCAVMDLSLGGHWRSTNCSQERHAACRVGNHPFTWSLSSGAYTYSDAFDHACPE

SEQ ID NO: 43350 - protein, 180 aa, A.fumigatus
GLTNLISVCGLTGVESPIPPFGGSGDFDISPSAIVFVAKDPNLNPATHTSCSCYYCPMFSWTGVGALEAKVCTVKGLEGAMSSPVLSSDGSSIALLGMREDGYESDKNRILYVPNPWNGEMIEIFASADGKGQWDLSPSGLTFAKDDQSLFVQVEEQGRGVLYQLPLDKSVFTTGLEITR

SEQ ID NO: 43351 - protein, 80 aa, A.fumigatus
  UNSURE (28): Identity of amino acid sequences at the above locations are unknown.
SANKPYVEPCTTQVRSRSIYDPWFWSVXPQQTVIKAVMDYRSWAYHTISFLGTRLEAISAVPYKPLHKFYKIYSVRAMVV

SEQ ID NO: 43352 - protein, 85 aa, A.fumigatus
MFRWRATDGPSFFSNKYRQIEGKKFLGVRVPKGGKSRVDNRYQKNRPGFFLPGAAAALFNPAPAFHSRAKNVECLRFCSFSHSFL

SEQ ID NO: 43353 - protein, 98 aa, A.fumigatus
  UNSURE (11): Identity of amino acid sequences at the above locations are unknown.
SPHILPVGCVXKSTQAALVQGAALRGLEGLQSTTKRCRRHYGFSWNIPFRDGIDSELDAIYDEYDDMKRVSGIMEWMIAKVGAPEPDLLDLSLWNMLI

SEQ ID NO: 43354 - protein, 176 aa, A.fumigatus
APNGGYVQVQPPLITSSDCEGAGETFTVLPRETIMDPKSEGNHFFRAPKYLTVSSQLHLEAYAAELGNVWAISPTFRAEKSDTPRHLSEFYMLEAEMNFMDDLDSLTDAVEYVVRDLTRRLYQSPVGQEILTAKRSGESGQDDAGNGAVPNLRQRWVDLMEGPRWRRITYTQAMEL

SEQ ID NO: 43355 - protein, 63 aa, A.fumigatus
  UNSURE (9),(35),(45): Identity of amino acid sequences at the above locations are unknown.
REVGDVFSXVSSLLGGLTKDKKGKPNTVSREKTSXAALNFAEASXWFLEFRRMKGSLTKGISI

SEQ ID NO: 43356 - protein, 67 aa, A.fumigatus
  UNSURE (18),(29),(55): Identity of amino acid sequences at the above locations are unknown.
MLIPFVRLPFMRRNSKNXCDASAKFKAAXDVFSLETVFGLPFLSLVKPPSKLETXLNTSPTSLYNSL

SEQ ID NO: 43357 - protein, 172 aa, A.fumigatus
TPMRGSFGPCGVKNSLLPRFWSAYDALSLTSESPTLLLKALPLAQHLHRAILRTGTSLLSKHQIRHLRAFRIAVVKDGPDVKLFTNPGALTKLALWIAEAIRVQYRERGDSVKIGKKRAAGTPLVLAGLDEDRGLYVVVGTGGGGGVIDYAAMHKRQEERRKKNESNDNNQI

SEQ ID NO: 43358 - protein, 73 aa, A.fumigatus
  UNSURE (19),(23),(54): Identity of amino acid sequences at the above locations are unknown.
LDMRGNKHLLRKRFGIAFXEVVXENNTRVRIDSFEHCVLKIQKGELGGFLEALXFRTVLRLKSESPCRLPCSK

SEQ ID NO: 43359 - protein, 103 aa, A.fumigatus
LTATCSVIIATIIEIAFSRDVRHSTDPTYDYCPITIASQVVQCASIVTACWGQLKPFLNQLKSNGLRIQGVQYQYSTGKGQSSRSYGRSGTNQSSPRGTKIRG

SEQ ID NO: 43360 - protein, 181 aa, A.fumigatus
NRFYLVVSGDSCYDIAAAQGISLDNFYTWNPAVGSSCGGLWPDYYVCVGVISDGTTTTTTTTTPSTTSTTTTTAGNGVITPTPIQTGMVTNCNKFYQVVSGDGCYDIAAAAGIALNDFYTWNPAVGNTCAGLWPDYYVCVGIIGSSGTTTTKTTSTTTSGNGVATPTPSFLHGSQRPRKEG

SEQ ID NO: 43361 - protein, 65 aa, A.fumigatus
CPSPLSAAAATHIIHQTESEAGSLRQSGSTPKQPKSTLIQLLFSGDSNEIQEQGVVPILGYPAYV

SEQ ID NO: 43362 - protein, 251 aa, A.fumigatus
CLTAGRADNKVQKLVDADGSELPLFIHFEHIPSSFVQLSLLISAQSVPVHLRPFLSVYTEAFFNLPVQRDGKTINFEQVVVELERDTVGYSMEGARSLGNSEMLRISFQVEIEKYSNAIAWLKELSWNSVFDVERLRAITSRLLADVPDAKRSGDDMLAAVHVMVHYAPESIVRARSTLVKARYLKRIKRQLAEQPKTVVARMEEIRQALFRFENMRVLVIADIDKLPNPVSSWKPYAERVLTRRWPISVN

SEQ ID NO: 43363 - protein, 323 aa, A.fumigatus
  UNSURE (236),(237),(245),(246),(249): Identity of amino acid sequences at the above locations are unknown.
RVSVKIRILETPEKTESLVKRLVATGITGLTVHCRTTPMRPRERAIRDQLAMIARICREAGVACVMNGDVTSRDEALALMKEFGVDGAMIATAAEANPSCFRSEAEGGLLPWREVVHDYLQAAIECENRFGNTKFLLNILIPGKNREFKDAKTAKSYSDYCHFLKFDDLLPGAAQLDKILILTDNSVYKNNKPEDPARNIAFKTPPKITKTVLAATGPPRPKPAPQPGTGEGPFPXXPSPTPASXXPRXLPIELPGSSSQRLLPKPELGRLNFTFSSPPNPVPGDFNFIPLSPIFPNLLGLPEFQIRLFWLFVWKKPPRGSLV

SEQ ID NO: 43364 - protein, 246 aa, A.fumigatus
  UNSURE (12),(13),(14),(33),(57),(58): Identity of amino acid sequences at the above locations are unknown.
FILVFSYLLFPXXXLFLCMFFFLSFFFLFFSAXLLSFSSFHWVRCVSFYSRTGGAAXXQAGAPSPIAVVGMGMRLPGAVRTADDFWDALISQKDCSSEVPQTRYNIDAFYHPDKPQSVRTRRGYFLEDDYLQKADTNFLQWIPGFSTSELDPQQRLLLEVIWECMENAGQTGWRGKDIGCYVGVFGEDWHQLTAKESQMIPRTHPFANGWFALSNRVSFEFDLKGPKLMGSSHPPWKISLLGQYLR

SEQ ID NO: 43365 - protein, 187 aa, A.fumigatus
  UNSURE (58): Identity of amino acid sequences at the above locations are unknown.
LFPYHDTGNVTLDAFNVSQRVGTDLQFRCIDQATVFAGVTSGVFQPSYFYQIQRTTGXYDPNNLGGPPATPEFPNGDPELPYFRLHGADLPWVFGTLTTLREPLDLFSMQLVSAYFAEFVRSGQPNPAPEYLQARGYKQTLDAVNNFDRWEPVSHSEGPLQLLDYPSVKDPLPGLLPRGPADPRYAV

SEQ ID NO: 43366 - protein, 60 aa, A.fumigatus
SKRRSVPLFHESATFPPFMTYPVPNLQINIWVLFFQPGQPSPEMLWVEFLKGFGMNLIIL

SEQ ID NO: 43367 - protein, 94 aa, A.fumigatus
HSLLIPIVYIFSSSNPLPLLKFNNICTMKLTTVSILAAVSSALAVPTNIKRDSYIQISDFWARAGPTSPGASMHFVVTDPNYPEDTPTDCNLIW

SEQ ID NO: 43368 - protein, 96 aa, A.fumigatus
PTLLLLSRTYGHAPKEGARCNNGEYYIKFPNGAPDFNLFTLELQRVSGPIAEDGHVLLSSNANGGAPGTKWICVNDPKPGVEISCSYDGVLQMQVA

SEQ ID NO: 43369 - protein, 182 aa, A.fumigatus
SPLSAAFSPPVGENRGKESFASCLLNNSHMSLSDLDRHVIRTYRDACRRLDTGESQTRENHMQAVREYEQSLQTNGPVNLYFDLATRTKMGEELDNLHDMWSYVRYEKYLPATVNEDAEHHPSSKVSDPWHKAFWKPLYGRLEAEAGAWAQVLSGKNHLYDCPTYLLAAPLCEHQTRDWGET

SEQ ID NO: 43370 - protein, 151 aa, A.fumigatus
SSFGWQSDGLRGHIYADKTNSTIVISLKGTSPALFDGAGTTTNDKINDNLFFSCCCGQGGSYLWRQVCDCQQSAFTANLTCIVEAMNDENRYYRAAIDLYSNVTDMYPDANVWLTGHSLGGAMSSLLGLTFGLPVVTFEAVPEALPAARLV

SEQ ID NO: 43371 - protein, 172 aa, A.fumigatus
  UNSURE (151): Identity of amino acid sequences at the above locations are unknown.
DQAMKDAGPLKPPVVDERKPLTQDEIALQALIRESKGETEGRTDLVIESAKREVDEGYPVRLDETGSFRVDVASRPEPATLDQYNAIPVEEFGAALLRGMGWKEGQSIGRGKYGTSATDYTSQTPRIPERRPGFLGIGAKDVSGGNGAKAXLGAWGRAAMRKGARKAKNPGG

SEQ ID NO: 43372 - protein, 71 aa, A.fumigatus
PTPCPTPADYGNYGDYGKYGKYGDYGQYKVKRDDEPCTTTTETPTPSPTPADYGDYGNYGNYGNYGTYENY

SEQ ID NO: 43373 - protein, 193 aa, A.fumigatus
FEARVRPAPWAEDDAAVIACRGGMYTILATAHDYELGGASLDQIVIDHFAKEFIKKHKTDPRENARGLAKLKLEGEATRRALSLGTNASLSIESLADGIDFSSTINRTRYELLSGKVFAQFTRLIEQVVQKAELDVLDIDEVIFSGGTSHTPKIAQLARNMFSEKTKILAPSTSASAINPSELAPRGAAIQAS

SEQ ID NO: 43374 - protein, 183 aa, A.fumigatus
LRYGNWFKTVHKFKPREIVAVDFMNSSTVIFFLLGLWSIGAVPAFINYNLTGKPLTHSVRTSTARLLIVDDEVRDCFPPEQLEIFASSDFREDKGAVEVVFFTPDVEAQVMQTEPVREDDKARSGPVLRDMAMLIYTSGTTGLPKPAIVSWRKCWTGSTFVSNWLGLKPADRFSPGHAGMKEW

SEQ ID NO: 43375 - protein, 156 aa, A.fumigatus
  UNSURE (61),(138): Identity of amino acid sequences at the above locations are unknown.
HGRRLHSAIRYGITQALFAATALAQRRTIAEVICHEWSLGSIADRPVDILASCHRNDALQXDRMIMKKAPMLPHASFVHASDIGPHGMVLMDYVDTVARRIRQRAPPGYHPRLHFDVYGTLGDVFPETTRLADFLGRXRQRARPYALLIESPIIAP

SEQ ID NO: 43376 - protein, 84 aa, A.fumigatus
  UNSURE (81),(82): Identity of amino acid sequences at the above locations are unknown.
KPAQIQRLAALRACLKRKSIDVRIVADEWCNTLPDIRDFADADAVDYVQIKMPDLGGVDQSIDAVLYWSSPRRLAGSAHTXXPQ

SEQ ID NO: 43377 - protein, 149 aa, A.fumigatus
LIASLYRHCFRRAASRLLSLPVTAPTWSARALAPRVPLPVLSPLQSQLALHTRWFSDNTASQEPTSSPEHEHHGHSETVLAEPDTRDARPQKPKMRLRVLEENLRPRQTVYVGNLFYDVTAEDLKNHMQQFGVVERVDLITDNRGLSRR

SEQ ID NO: 43378 - protein, 83 aa, A.fumigatus
GCCDKLFSTRATVTDCISLQALLSASSQSPLVFAGHRADMVCQGPCTSRPTTRIIPSAISISFTYEMVQRQHRQPGADELTRA

SEQ ID NO: 43379 - protein, 137 aa, A.fumigatus
GHLTDTVMVEKKFVPITLFPKKARRFTHSGLVAFFLFIYFCITKTSHHVGEPGSYSTPVKAKVGETFPRKIWQIWKVNPLEFDARDIDVARSWTAKNPGYRYEILTDQNDLEYVEANFGPLGENRPHIVETYRSLNA

SEQ ID NO: 43380 - protein, 105 aa, A.fumigatus
NLRQAHLRSVRPWETMPKSSMPPLSGTIPNYVLMGVGAWSAGYHMTLKYHTQMCMHPCLSSLPPWLSLPRILSVFQRMNYQCIYLSRFFCTGSSLSRLAFSAPGS

SEQ ID NO: 43381 - protein, 125 aa, A.fumigatus
SEVSDFSTSEDSFTDEDGDDEDGGAPVPDMPAPTSERGVALSFPYLELYGIELLELVGLYITVKCDRCKEHLDVRNIPQVKDKSDALAPKVETCKKCTNTMSLGKNILFHSLKGGKNPKTPKNSH

SEQ ID NO: 43382 - protein, 109 aa, A.fumigatus
PAIDALSASPAVKKYPITGQTTFLIHSPWFESLTIDLGGVKQLRVTATGGDGNGDSKIYVQSLKVNGNPWRKNWLTWHDVFENGGTLEFELGESPSGWFTGELPPSPAS

SEQ ID NO: 43383 - protein, 276 aa, A.fumigatus
  UNSURE (30),(271): Identity of amino acid sequences at the above locations are unknown.
PTLLSDRRLLSSSPIPNPHTHFPSFGKWQXPSNQPTPILMNGINMSGMLQTPARPRPPGTMVPLFRPVEKATDAAELTDVLASSGIDVREEEAFLTSSYSAPGVQAQQSLRVQQPPSSQQQPQQALNTSFASQAFTTGTISTTPSFSEPSQFKPQVTQDSFYTEPASQPPAPFKDPNEPTREDTEAARRAQYHLQEPFLLTKVLEQRLQRRGFELGVRIPAEGLFHPVPGRPQPIEVTGPDGSSIVRTGKTILNQEGAPLVDILNLLSIAXVITPG

SEQ ID NO: 43384 - protein, 65 aa, A.fumigatus
  UNSURE (30): Identity of amino acid sequences at the above locations are unknown.
SHLVKRQAPFIIFANPQSPYAFPQFWEVAXTVKSTNPNSYEWDQHEWDASNTGPATAPRHDGSTF

SEQ ID NO: 43385 - protein, 236 aa, A.fumigatus
HTKVCDRRVCPSRLRLNETEDYSGGGAGGTGQSEANYVDPLADGSKCERDIPYLLQLRTNVIRTYAVNPSLNHDACMQKLSDAGIYVITDLASPDESITSNSPVWTVDQYARYTSVIDAFQKYDNVIGFFAGNEVVNQANQSAGAAFVKAAARDMNAYIKTNGYRQSLAIGYATTDNPEIRLSLSDYLNCGEQADAVDFFGYNIYQWCRDKTFQTSGYHNRTEDYNDYSIPIFFSE

SEQ ID NO: 43386 - protein, 71 aa, A.fumigatus
NRREDATLEPEELDFNRSNLILEFRETLKFGVISSQKRAEQRFIQCIVSRGNSSAWIYIYHDDKSESCIPL

SEQ ID NO: 43387 - protein, 112 aa, A.fumigatus
GTLAVRPPCAVHQQFGEALSSIMGPSAGENAHETDQDSRYCSLIDFDADDPDLPLNWSFSRKIWVTSMVAILNLIGTIASSIFGTGIKDFMQEFNVSNEIAVQGTTLFLAVR

SEQ ID NO: 43388 - protein, 137 aa, A.fumigatus
KMAHFLASELGALGAEVEQRPLGKQPGKEHLDLPPVVIARYGNDKNKRTILVYGHYDVQPALKDDGWATEPFELTIDDQGRMFGRGSTDDKGPVLGWLNVIEAHQKAGVELPVNLLCCFEGMEEYGSKGLEEFIKSE

SEQ ID NO: 43389 - protein, 65 aa, A.fumigatus
IHNCYSLFVPLKFRTPDFITVTGMSDKKSGCRELRDLLTPRNFVSNPPISFAICNPRAAYARNVP

SEQ ID NO: 43390 - protein, 70 aa, A.fumigatus
RLPVVCNQDELVVFESPPNTTCGEYAMPWLSSTGSGYLSNPDGSGHCGYCKYSRGDDVSLIWLGMSQRGC

SEQ ID NO: 43391 - protein, 182 aa, A.fumigatus
VDDFISGLWKVHLSVKKEGYVQNLSLGLYRSDYMAHAPTNANTPSLKQVEFNTISSSFGGLSSLVRKLHSELLTSPPGYPISYPFHPLFESNVPPENTAVETLSAGLAAAHSAYGPSKSTPALPTCILFVVQENERNIFDQLALSRQLTTVHKIPVFRLHSTEVLDHTSIPASSAHAGQRNG

SEQ ID NO: 43392 - protein, 192 aa, A.fumigatus
NCIASVVRPACGETVIIGEGLQQYKSLRDLEKRLDASIVRKRLDIQDSISKTVKKYRTMRIWISNTVENQPWQTGAGQNGAAPGSNPGSGRYKVRIEGRLLDDDTDPTAPDHSEDEGENAEENGDTMEHDGQDAEKAKKPAAKRPKQRFSHFFKSITIDFDKSPSSNPEETKTISWTKPQLPANAVTLPPIA

SEQ ID NO: 43393 - protein, 87 aa, A.fumigatus
LTLRSVRTQSATNDLYLIAPRRSIIRHSRRPQHCVDKNLQQIRIPLRHVNIVWSILPDDIDGPKKKVNTRVGGAVEWFFSSQYGLRT

SEQ ID NO: 43394 - protein, 180 aa, A.fumigatus
  UNSURE (105),(133),(164),(172): Identity of amino acid sequences at the above locations are unknown.
AARFLPAPVGEDGKEHGLDLARAQTDSNVGNGDVLSLTRAVGDHDTPVVGVGVLGGLDGLGEGTDLVDLEQEGVAGLELDGLLDTPRVGNSQVITNNLEVRGLVXVSPGLPIILNEGVLNADNGVLGSKGLVXVGKLLVGEPLGGVALGVLEVKVVLLDVGLVXLAGGNVHXHLDLAGVT

SEQ ID NO: 43395 - protein, 180 aa, A.fumigatus
  UNSURE (9),(17),(48),(76): Identity of amino acid sequences at the above locations are unknown.
GNTGKIKMXMDVASSEXYKADVKKYDLDFKNPESDPSKWLTYEQLADXYKSLAAKYPIVSIEDPFVEDDWEAWRYXHKTSDFQIVGDDLTVTNPGRIKKAIELKSCNALLLKVNQIGTLTESIQAAKDSYADNWGVMVSHRSGETEDVTIADIAVGLRSGQIKTVFLAVFTHGGWKETRC

SEQ ID NO: 43396 - protein, 153 aa, A.fumigatus
SDLGCGSAHPRWMKTHNVIINQLFGQETGLGMSLLTFDWAQVVFANQSPLLVPFWAGLNVMGSCALFYWIICPIIYYTNTWYSAYMPMMNSNTFEGTGRPYHTKNVMDRDGTIDTEAYRRYSPMFLPTRYALTYGIAFANLTGIFVHVALYNG

SEQ ID NO: 43397 - protein, 245 aa, A.fumigatus
  UNSURE (49),(54),(114),(241): Identity of amino acid sequences at the above locations are unknown.
AFGNFGRTESLSLPEFTRKEFETGDVNLGSAVIQSTSEIFAVGRIASNXLEGKXNPASLVFETSRRTGAGLRVPLNLDSIQSANFFAGQIVALRGINASGNYFSVKEVLPPPLXPRAASSPVSVDTINQRLEQAGSPSPLNVLIASGPYTADDNLAFEPLHEICQKAAETYADSLVLMGPFLDIEHPLLASGDFDLPEMEGFDPDTATLATVFRHFITVPLQKLVAAVPSITIVMIPSVRXGTPP

SEQ ID NO: 43398 - protein, 108 aa, A.fumigatus
QLVLIFGPPSTYPSPVNTGKRIALPTRVEPKVFFANERTFLSWLNFTVILGGLAVGLLNFGDRVGRISAGLFTIIAMAAMLYALFTFHWRAQSIRQRGQSGIDDRYGP

SEQ ID NO: 43399 - protein, 128 aa, A.fumigatus
  UNSURE (37),(41),(52): Identity of amino acid sequences at the above locations are unknown.
AKIETCTTQEDAQVTSEKDQKLEPSTSVAVSQGAGEXDIPXRTYRQKIALIXYLEDDQTTWYQYFRRPFFLFAFPNIVLAGIQFAFGCTAGIISFNTISEIMTEPPYNWSAGSVGLLFLAALVGNFIG

SEQ ID NO: 43400 - protein, 67 aa, A.fumigatus
PTSPLVPLGTSQPADLNVRQKKEEDLTKPSEKDAVSYLPSGIMDDASFEVTWSNEELVGSRRFIYIN

SEQ ID NO: 43401 - protein, 132 aa, A.fumigatus
WIFSRVHTLLPVSMRKFLPAADAMLEMICIHLPSPVTAQKYRAETLYEGPMDDECAIGIRDCDPKAPLMLYVSKMVPTSDKGRFYAFGRVFSGIVKSGLKVRIQGPNYIPGKKDDLFVKAIQRTILMMGRFV

SEQ ID NO: 43402 - protein, 69 aa, A.fumigatus
VTSHIDSEANEREIVEEERSLTDHNDKGEGPETESAWANEAITGLCISRTGHIFATMTDSSIAVWQTRV

SEQ ID NO: 43403 - protein, 103 aa, A.fumigatus
  UNSURE (100): Identity of amino acid sequences at the above locations are unknown.
PTTVVAAIARSASSMKTYGSNVAVLMHPDSTILAVQTLGGYLLTYTIATDPTSRVYQQHFDQSSQSRRQQLARLSAEDDANAMPDVSLLPQGAKGRGEAXNPH

SEQ ID NO: 43404 - protein, 125 aa, A.fumigatus
  UNSURE (125): Identity of amino acid sequences at the above locations are unknown.
PFDAYIPGYLLLSLGGPFIFISSFQLSNTFPTRSGLILSMLTGAFDASSALFLIFRLTNERTNGSFTSHRFFMVYLIVPAFILAAQLLVMPATSYKTAGELVQQAEAYIVDEANDRVDERIHARX

SEQ ID NO: 43405 - protein, 80 aa, A.fumigatus
FGTLGSHLVISVECLGKTPGEEGGQMYTVGPNYWFKHFSPLIGRLTGTKDEVQSSDGKKAVSRYKYVISDLATLNADCLF

SEQ ID NO: 43406 - protein, 188 aa, A.fumigatus
PPHASPPRCEDPMLAQHTVANNHGREPPLQLLSPAHISNGLPRTSYQDSQLQTSPASSKSGPAGSVQRSNNGSLSKPLPTPAQTPVQNSFLATPFQNYDPSAHDASQAEAEAAMRRAVMEQQQQQQSQNQSSDYSLAPSVSTVSHNSPVTPQTNLDEIDDASKAMANGENRYPDVDRWMDEYLHADAL

SEQ ID NO: 43407 - protein, 190 aa, A.fumigatus
THFSTELDEPGANRAMERIPKETLQQLYFHTLLDLDKDILSGALDFWYQYTLSSENIETLIEVFNLPTVFVPRMVALLTHEGRPYKKETVLQEEKVAPPPSDIPRVPPELMKELMELSEPERSSRWLRCCFVEDLECEITQIALWQAYQSRFADPRLRWGGGCGGGGGGQKCQYDFRLHAAPGRYRVGGG

SEQ ID NO: 43408 - protein, 84 aa, A.fumigatus
RPLRFTFDPRACKTGKQFELRSKVIGVYDKGKAGSVMETEQTIVDKATGEIYTKIVSSGFFVGQGNWGGPKGQLLTSFFSNCGH

SEQ ID NO: 43409 - protein, 114 aa, A.fumigatus
  UNSURE (93),(114): Identity of amino acid sequences at the above locations are unknown.
SLNGDYNPLHATPEPGQQMGFGGTIIHGLFSWNSTAHAVLKAFGGSDPNNFREFQARFASPVRPGDRLTTEMWRVGNATDGFEKIRFVTKNDXGKVLLSNGPALIKVPNSGSKX

SEQ ID NO: 43410 - protein, 208 aa, A.fumigatus
HYFSTAAVKTLMTHVPMKRKVILSVLFALSLILVGITCYRVPSVIWHHGSQQYRSLLASLEILAATAVSNAVVIGSFVRDKGVKNAKFKKDVGSASVSESMDHSSTRRATITYHQWGSDSDLAGDLGIRLAPELQASDHKIPRPAPIAVPYHPLTAQTGTLTANWSFGNQRHSIGTDDDKTSTTGSLELKISPHEYIETIKTPHKKVQ

SEQ ID NO: 43411 - protein, 217 aa, A.fumigatus
SYFHAALIINKCLSSTNLNPYFIFCLKPNDRRIANQFDSKCVRAQVQMFGIAEISQRLRNADFSVFLPFAEFLGLAEIGNIVVGSDKEKAEVVLDEKRWPGNEATVGSTGVFLSERCWADLAKVGERVVPVYAADMSDDRGDGLLHPRSTGYGDSKVRLLNPADQSPGAFIYGDQAKHGYFGSRDLDGRSDAGNSAFNSGDMFPNHETREQMLEKGK

SEQ ID NO: 43412 - protein, 62 aa, A.fumigatus
IGPASLAQEHTSAADCSLIAWPTLLIKDDFRFLFVTANDDVANFRQTKKLSEWKENAKVRVP

SEQ ID NO: 43413 - protein, 174 aa, A.fumigatus
  UNSURE (5): Identity of amino acid sequences at the above locations are unknown.
SFQPXGEDSFLHVLDTPHSRKHLRGGCELEAVLAPFTDSLSDSIHNGRLKSSAKAISAMLKTWPGLIILARHEAKPLQSLLESLHYPDPQARDLIMELLFDALRIKPPSWSSSFLAGRRLTTYGRVANLRSESDAKPVRAFYDSNDDRFDLTAHFSTLILATLIDAGLSQVCFS

SEQ ID NO: 43414 - protein, 171 aa, A.fumigatus
GRKQGFRCYWRGKNHCHGQHCVGDCGVDVLLSRLVDVFDEVLAHTAASSNTSNEGEDGLRITWKDFKGQEPTHNCANIGPDVLRGVYNLVKQGRFDCDATEIIYERALEDCSGDVDQSSALFERLKDSIRNELDCQVCYSLITDPLTTPCGHTFCRGCVFTHGGWQDPRLR

SEQ ID NO: 43415 - protein, 191 aa, A.fumigatus
LSASLDDRRPSAKDGDTNNSHRDKKPSTKAKPMKLDLHFTPAHPQETTTSKAESPAQTAPTRYVAAPVSAVGSRPNTPMTGVSRASDSSAPRQPRVLRVVDTPKTETPPPASTSQSSASLPTTLKTRSRRPSISSLSRPDTPGDLGSEADLYTSASASRANSPPASSRIGSAPVRSISKSQGLRAGARSAY

SEQ ID NO: 43416 - protein, 143 aa, A.fumigatus
GVYADHCLNWTNSLLIVLAVVSTISWFIRYRFLNMYSRLPPEPQRKEPQVDLFPDVQEGDSKPGLANYLDEFLSAIKVFGYLERPVFHELTRTMQTRKLIAGETLMLEEEKGFCLVVDGLVQIFVKSMRARKVFTPAAKDRAS

SEQ ID NO: 43417 - protein, 166 aa, A.fumigatus
RYDDSVHSHGRPHPQESARHKAHTPKRTSKTNQANVTSLMSYDVDAIYNSRDIFYVATAVPISTTIAMVFLYRMLGWPSLFGVLTLCCLTPLPALASRRVSRIQQSVMRATDIRLARISEYLNSIRTLKFFGWEPAAVASINEIRHVEQRRLWRRSVFAAAISMAG

SEQ ID NO: 43418 - protein, 185 aa, A.fumigatus
VLGVSAEPTIWAPASELIGRRWPITVGMIGYSIFTMGTATAKDTQTLFITRFFGGLFAAGPFTIEPDAFADMYNDSQRGIAIAMFAMAVFVGPFASPFTGGFITMSYLGWRWTMYISAIMGFFGVVLLIFFYKETYAPVVLMEKAAMLRPQTHDWRIHAKQDEVELDKLCMDSSPQGPKDPRKRP

SEQ ID NO: 43419 - protein, 263 aa, A.fumigatus
WNFRGPPHFITLMGKPLTEVVIFRFRTYYTNSYLNSVIPQEFAMISGNASAHSQAEADHPYNGLECFCEGSSERESDIAKFPTSTCDQHLQLNLLFPQCFNPDDHSEYDFADESNTCPEGMLQMPQLRYRVQYDTKSVAPDGWSGPAPFQLSCSDTPGDGYCFHADFINGWFEDAAENMLINGGGGYEDGQFISGEHGTSAVKATCTPTDQDPDNGTSDYYTSLEMMDDGAAAGDAVASDATVATGDATSTSVGLHHDAAGSR

SEQ ID NO: 43420 - protein, 182 aa, A.fumigatus
YPLTASPCSPAGVKQAMVKVAVLLTERYGRVLRRGRKDRIKLLFGSLADVGRRNVSTSPDTEDVCRETDDTVKPHVTGFEVDAPANDDYGDEDEDEDDDDLALAALESLDAIDVFKHDSRVDKKVYEARISVATLRRLLMLFLVIAPLKTLEPVTLYTSDLNEARMESIRKEADTILAAFST

SEQ ID NO: 43421 - protein, 102 aa, A.fumigatus
CSDGYTSFIDLLIDTRVVLEHVNSIQRFQGRQGEIIIILILILIPVVIVGRRIDLKACHMRFDSIICLPTYILRVWRRADITSPNVSETSEQELDAVLAPSS

SEQ ID NO: 43422 - protein, 76 aa, A.fumigatus
FHSNIVLQWYTKQEQNNRVNIWFSFNGWGQIFGGLLPYGIAVGTANNGSAIEPWKIVFLFTGLLTMALGVIFLWVV

SEQ ID NO: 43423 - protein, 196 aa, A.fumigatus
  UNSURE (12),(14),(19),(24),(25),(27),(30),(40),(122): Identity of amino acid sequences at the above locations are unknown.
AILRACPVTIEXRXTGPPXFKIGXXSXEDXPWCPVCLSSXISKRWNIRPLPLKQVIRHHSLQNLSLAIDELVSDPRTVSTMPFLEMTPVARNGQLPLSYLEKEMLLNHLISGGSPAGNMNPXCNYFFLFNAETPAHASHRVTAYVEVSRTTYSVIEGTLYRQQAPRSVNVPPVVQTGNPCSYVHGRITLSFDSTTQ

SEQ ID NO: 43424 - protein, 96 aa, A.fumigatus
  UNSURE (50): Identity of amino acid sequences at the above locations are unknown.
RLFSTRPLSDSRHHSSLLRYKAVEMSGPVDTAKSITKKRKRKHGGGARAXTETDDAITRPAIENGAVNDSPEKEEDTKKSEKNGKDKSAKKRKVSH

SEQ ID NO: 43425 - protein, 74 aa, A.fumigatus
ARLAQHGERLLQASGRFVVSYPVSLTWIRISADFYSPHHPLSSSTGTHTFLSFSYKKQKGVYMTMYYNPRVYST

SEQ ID NO: 43426 - protein, 156 aa, A.fumigatus
  UNSURE (122),(154): Identity of amino acid sequences at the above locations are unknown.
KPRPSDVILAMALRTSADNAEDVAAGFRMLRDPLPEHATEITSLIADLYSISTSLTSLDDLTKNRHYRRNVAIAKEDLDLVQTSLKYTLEDIVDFFGDIEVQKGSNREVYKRTWLGLTAFFXKESHEPLPTRLAKYKAFLRELEDLIKGYVQLXFV

SEQ ID NO: 43427 - protein, 292 aa, A.fumigatus
  UNSURE (16),(71),(83): Identity of amino acid sequences at the above locations are unknown.
ARPAMGFQANPLLQKXRTGMNKGGFPRPKGAEGDFFTLAWKEFFRGSPSSLEIGAKFRVDVYEWDFGDKAXYLGGANINLEMXEPFHSQEVTLTLDGKSGAIRLNLLFKSNYVMRSRQGSSTFSGTFATPGKIVGAPVKGVGFVGGNVIKGASFLKHGIMSRFKGDDSSSDEIPEEPEEVSKTETTQTPSAILVDGATPPSSTPNSLQHARTRSVVSHFGDRLGIGGSAGKGETGTATITVVSASNYPPSSNVRVIIKALGPKGAKEVLKTKAIKASGGLHHRGRRLRAKRN

SEQ ID NO: 43428 - protein, 167 aa, A.fumigatus
RLQFERGTISYMLTSTLTKPTTMNPTVSCRRRVNFLENIDIAPFPAPKARIVTLEPVTRRSKPKGKAKSVESDAAADVQSREPSLNGSGAVGDNRPPLSPAPSNVSSSSRLSNSSQSFQLASDPSSSAGTGVRNGSITPSIADKTITAKTELFTGWCLHHEAAKDPH

SEQ ID NO: 43429 - protein, 234 aa, A.fumigatus
  UNSURE (8),(13),(219): Identity of amino acid sequences at the above locations are unknown.
LASLVISXENLIXGQPDTDLSNVTGQMFNNRVYEMSIAKPGQPVSACKVPESLTEAIENSIQAHPDIYAVEGLTGRLTYREFGRMTEHISQRLLQHIQPGSVACMISDGSLLWLLAMVAIIRAGAIYCPVDEKLPRDRKDYMVRNSRAALILYANSSQEPLCNGVPSLNMESIMQEISSSSGSPIATSRNRPSGDTVACLVYTSGSTGLPKGMLNFKHXTLFSHTGAGSISAVH

SEQ ID NO: 43430 - protein, 67 aa, A.fumigatus
YFHPAITSQPPLLWIPRDKLGVSKQEVKHTARVIPITDEDAWLDDKNKIHWDVDKGVPPIFEEKIYY

SEQ ID NO: 43431 - protein, 128 aa, A.fumigatus
DISQIRVKNLESKTYIDKTQNATTHTENSPALEIDKETDRVYRALDPKVPIIVASAADDKPIFSVTREGLNDVVVWNPWIEKAKGMADFSPDDAYKKMICIEAGSVASWQTLEAGESWEGSQSIRPRL

SEQ ID NO: 43432 - protein, 200 aa, A.fumigatus
GVSGFLDQYARYDDFENFMRLYATSRTDVNFTVVSINDGLNLQDSSLSSTEASLDVQYAYSLAYKALGTYYTTGGRGPVVPEEGQDTNVSTNEPYLDQLHYLLDLPDEELPAVLSTSYGEDEQSVPESYSNATCNLFAQLGARGVSIIFSSGDSGVGSTCITNDGTKTTRFLPVFPASCPFVTAVGGTHVVFAKGGRSAS

SEQ ID NO: 43433 - protein, 157 aa, A.fumigatus
  UNSURE (15),(20): Identity of amino acid sequences at the above locations are unknown.
ARWKYNQIFSRRSIXWGLSXLPLLQSKLLWALEYGGIEYAWNSATVIGLFCGAGATFLVFTAWEHRMGKDAMIPFHVIRNRIVSCSCVVIMFLFGMTITASYYLPIYFQAVRDKSALVSGVDLLPGVLCQIVMALVSGALSMSSVPSVVIHANVVLP

SEQ ID NO: 43434 - protein, 67 aa, A.fumigatus
AESVVHHMVKRAVEMEGTVTGEHGVGMVKRDYLEHEVGKTTVDTMRRVCYNLHNVFASSFAFYYSIY

SEQ ID NO: 43435 - protein, 61 aa, A.fumigatus
YMLVLVTYERAGSYEGLVMSSGQSVNACCLPDCCLVDLAIFAAFNVTYFLSSPRGRGSTHG

SEQ ID NO: 43436 - protein, 65 aa, A.fumigatus
SKMAEKRSDVDIDAHPVHERRDDALDYLDEHANVQDEATVDLAALRRKIDYRMSSPRGWKETQCV

SEQ ID NO: 43437 - protein, 75 aa, A.fumigatus
  UNSURE (24),(31),(59): Identity of amino acid sequences at the above locations are unknown.
GDKLNSDEPALLRTKHGMRKWLRXQKQSIAXSDHSRDANSQAMDADAAGETLAEGIEGXQERVIPRLLRPHVWCS

SEQ ID NO: 43438 - protein, 92 aa, A.fumigatus
  UNSURE (1),(8),(37),(74),(82): Identity of amino acid sequences at the above locations are unknown.
XTRNRASXKVITPAMQTRRPWMRMLLVRPWPRALKVXKKESFPDYYDLMSGVPDLPEQLLWKEDADWHVLDASXEVPRYLPXGAFCFIPDYN

SEQ ID NO: 43439 - protein, 188 aa, A.fumigatus
QSTVRRRESPISQEETQIAVELIFAVINELYSLSSAWNIRRTLLNAAKSYILRPGSPSLETIRSLLQESMIDANISDASIASYLTKLRENVLPTKEELESWPQPPSSVEKERMREIARKTLVLKGLPQALTSVMGAAASRESLERVFDCLQVEMIARGFVYSILLHALRALSYTDRAGRTRARRNSWG

SEQ ID NO: 43440 - protein, 167 aa, A.fumigatus
  UNSURE (97),(102): Identity of amino acid sequences at the above locations are unknown.
FRADGWEESLMDSPNRFLQNGPRGPGPRSVYSGYSVNRSDHTLLVGEFFRESPKNPIVLVKYPWNTNSGKLKTNDKSIVTATFAHCADFLRMQGGFXYDNTXYISRSNGRSPKAGDMFKWKPGKPAELRNRWFMAGNEDLSYNKVRKEYYTVSEYDGERFILAYNKM

SEQ ID NO: 43441 - protein, 147 aa, A.fumigatus
KTTVDHMKGLGADVIFAVDVGSIDDNTPQVYGDSLSGFWSVFNRWNPFSSCPYPPTLSEIQARLAYVSSIDNLERAKNIPGCLYMRPPIDGYSTLEFGKFDEIYQVGYAFGKQFLEKLKSEGSLPLSEETEENKKLLRTLAPRRASI

SEQ ID NO: 43442 - protein, 62 aa, A.fumigatus
FLLRYSHEMKKVQSKLDSVVWVRGLLSFEDHESLPITMAFLSEFIRVAGMLPFAALRPYCPQ

SEQ ID NO: 43443 - protein, 72 aa, A.fumigatus
VYSHFNGLSNTLSPPKRAVTPVNTISPPYPLPYPYPALHFSPAIKASLNGPLSTFPIPRPEHKNPNTMPGSA

SEQ ID NO: 43444 - protein, 107 aa, A.fumigatus
ASSLNIAVQDGPEAGQSVAHVHAHIIPRKRADLDHRGGMDAVYDLLDGEEGDLRRAFEEGKEGERRPRAKFPAVDNEGRSPRSMEEMEAEAEMLAREMERMEREVVG

SEQ ID NO: 43445 - protein, 132 aa, A.fumigatus
  UNSURE (2),(3),(6),(45),(51),(119),(121): Identity of amino acid sequences at the above locations are unknown.
FXXDLXTGRPVRPSRWHSTRTPQGAWAPAKGDELPKDQFGGYSCXWGEFDXDSKINHGWSGWDVSAIQAENAHHEVQGMKICNHAGELCSIISHGLSKVIDAYTADLAGVDGIGGKVVXGXTRLVVNLDYKE

SEQ ID NO: 43446 - protein, 272 aa, A.fumigatus
  UNSURE (137): Identity of amino acid sequences at the above locations are unknown.
LCLLTALERERNQSSKMGLRLRPPKQSQRVLPVKPPKGHFFFAGREFARLPWWKRRNMRTLYIFIVILILTNTANGFDGSMMNGLQTLSYWQNYFNHPRGSILGLFNASMSLGSLIGLFIVPYLIDWAGRKIGLAIXCVIMLLAVALQSGATNFGMFVAARIILRFGDCIVLGNAPLLIGEIGPPQDRAILLTLRGTPYHSRGIHTQLGYPLVTLPIKVNFPELFASLGSHWLCQIGLKNKWFLGIAHFLATPLPPYSLLPASGGIPKNPLG

SEQ ID NO: 43447 - protein, 69 aa, A.fumigatus
FVHLCSGGVHIYQNFLGYLQALGYKHWIKIFTSKQTKIHANIGLSGHFISRHSEASAGNSILRFMARYI

SEQ ID NO: 43448 - protein, 70 aa, A.fumigatus
SSAVIERLFCCFSAYFLHLPSFFPSLFIFFSSLFIFLHPLFIPFIYVSLYFLQPASYSIPLPFLTYLFFF

SEQ ID NO: 43449 - protein, 136 aa, A.fumigatus
  UNSURE (113): Identity of amino acid sequences at the above locations are unknown.
KMWRSLRLLLISKKSVTQYVLTLVSGTDDRQVRTYRASSSRNMQATKQPPFVRLDLDVRLSRLDDDAEPGLVPSEPISAKYHAPEEEISLGPACWLWDYLRKNGAAGFFLPPXREVLTAALQLIIVHSMLREIVKA

SEQ ID NO: 43450 - protein, 67 aa, A.fumigatus
LVNPITWYGDTITFSHNDPGVEIISNSSGSHHELKKLDTRVNLITQATKLVSILLVCLLVSRTDTLV

SEQ ID NO: 43451 - protein, 68 aa, A.fumigatus
SGGIYLYANQQGCDGDRLYYDGCAMIVINGNIVAQGSQFSLKDVEVITATVDIEEVRHPVCSYTCFWY

SEQ ID NO: 43452 - protein, 93 aa, A.fumigatus
RPILFSHRLQNLSPDESLVYNVIHSTGRNGIWVRAIQSRTNLHKSILDRCLKSLEGKSYIKSVHNVKFPSRKMYMLAGLAPSEAGLHHGAGRY

SEQ ID NO: 43453 - protein, 186 aa, A.fumigatus
  UNSURE (15): Identity of amino acid sequences at the above locations are unknown.
ARVLPAPWVKTIFIXKKESHDSGFSDRGPAQFSSPDHTPTQLQHSPSTPRMSTLGKASSAMVYGIVQYDFQAERPDELDAKAGEAIIVIAQSNPEWFVAKPIGRLGGPGLIPVSFIELRDMQTGQAVSDPLEAVKRAGVPRVEEWKKMTAEYKNSSITLGKIDSAASAVQSVTSGVEKMSMGRNSA

SEQ ID NO: 43454 - protein, 64 aa, A.fumigatus
AGKSYSWTSAVNILLLIFWQSLFDHKELACAPYFFTSLRVLFLTALCLTIVVGRLLGESSCSYI

SEQ ID NO: 43455 - protein, 160 aa, A.fumigatus
NQKWQALHSQRSPSSTSHTYNYVYHAATASQATILLLHGFPSSCYDWRHQIHHFINLRYGVLAPDLLGYGGTSKPTAVEEYKLKSMAREIIELLEHEGLRQIHAVAHDTGCNLLSRLADYYPDRLLSCTFIAVPYSKPGEHFDLDMVNKFTKQLLGFEKC

SEQ ID NO: 43456 - protein, 97 aa, A.fumigatus
  UNSURE (61): Identity of amino acid sequences at the above locations are unknown.
RDESNTQTRDEIVNRVGRKAWIHVAELSKREEVKSIIPAVTSQGLKPEILFNCAGIQRRHXSEKFPDEDWDEVCQAIPWFLILQKLIAATNFLRLLK

SEQ ID NO: 43457 - protein, 164 aa, A.fumigatus
  UNSURE (150),(163): Identity of amino acid sequences at the above locations are unknown.
VIEVNLTSVFTLCREFGAYLLARDASDFPSGRRGSIINVASLLSFQGGITVPAYAASKGGIAQLTKALSNEWASKGINVNAIAPGYIDTDMNVALINDANRNAGIMARIPAGRWGKPDDFKGVIVFLASEASNYVSGEVVSVDGGWMDQXLHDRDWLEMRFGXA

SEQ ID NO: 43458 - protein, 194 aa, A.fumigatus
LVDCCTFVVKTELQALCESCGLTLSTAFSTAWGLTLRSFCGSNEVCFSYMASLRDVSVDEIGSVVGPVINLLACRMKVTEDVCLEDVLHQVQNDYMESLPYRHTSLIDIQHALKLSDTILLNSGISYRKLPPKTLSNRDEMRLVEVGKIHDPAEFPVYVNIEATDDVAYIDLNYWTTSLSEGQAQNVASTFLQS

SEQ ID NO: 43459 - protein, 67 aa, A.fumigatus
HGLGPPEEKTALNRTVGQGRVSKTQLATAVRKHFNSAALAEQEAIARFLYKVREEGRGRQFRLRFQP

SEQ ID NO: 43460 - protein, 194 aa, A.fumigatus
IPLGENIHVKANITVSDGTYIGFIILMFIGALLALCLCNASDIIRPDGSRVILMKHPSWQSELLGLWETLRFEPFVVLLFPMFFSSNWFYVYQQNSVNGAHFGTRTKALNSLLYFLAQILAAVIWGYLLDIKRVRRSVRAKITWVVLFVLTFAIWGGGYAYEKTYTRESVNPKLNPDFVPTDWVFAGRYEERSC

SEQ ID NO: 43461 - protein, 63 aa, A.fumigatus
  UNSURE (61): Identity of amino acid sequences at the above locations are unknown.
DRTSELAPWCRDGHEDSLVSSMTVNAYNMAGDVMKEYANAKCWTKETMPSTNAASTRRAPXYY

SEQ ID NO: 43462 - protein, 186 aa, A.fumigatus
TRFFIPACRLIGTCPEFDALDTEKAIEAASAAFPKFRTTLARERARMLRRWYQLMMDNAEDLATLITWENGKPLADAKGEVNYAASFFEWFSEEAPRIYGDTIPASVPGNRVMTLKQPVGVCGLITPWNFPAAMITRKVGPALAAGCTVVCKTPGETPFTANAIAELAHRAGIPKGVVNMVTSLKN

SEQ ID NO: 43463 - protein, 76 aa, A.fumigatus
SHHVDNSFGNTSTMSQLRNGVRCERCFARSLADNRATRRQSRSNLSCDHSSGEIPRRYQAADANGLLQRHDSVAGN

SEQ ID NO: 43464 - protein, 172 aa, A.fumigatus
  UNSURE (25),(60),(172): Identity of amino acid sequences at the above locations are unknown.
DSNLGHRHGVRRVGDGGAGGGGGGXSGSDGRTTGQRGSGSGSTGRSGDCIDAGGGDGGDXGDGGRDAGHDAGVLGYVGSADTSEVGQSGLDLRLRGSPGLHTSDDLVSELGGWAEAAGVTVGVALGEQAEPGVDTLGHNVGARGRRDRRRSGGHGWHVAGLAGGDRGLACGX

SEQ ID NO: 43465 - protein, 186 aa, A.fumigatus
  UNSURE (1),(113),(148): Identity of amino acid sequences at the above locations are unknown.
XPTGQSPVTASETSDVPSVTTTPSSVPSAPCPNVVPKCINTWLSLLPKCDSNSDASCFCPSSEFTDKVIACVQSWGASQAEVQAALSYFTGICAAYVPQNPGIVTGIPTTITXVPTVTPTGVDAVTAPTGAATATATLTGGAAVTPAXSAPSAPCTTITYSSYTVTVPQVAVLHRRGCQDTRLMGK

SEQ ID NO: 43466 - protein, 120 aa, A.fumigatus
  UNSURE (47),(83): Identity of amino acid sequences at the above locations are unknown.
QGHRLCAVLGSLAGGGPGRSVLLHWYLRCLRTPEPRHRDRHPDHHHXGPHRHPHRRRCSHRSYRCCHCHCHADRWCGRHSRSXRPLRPLHHHHLLVLHRDGAPGCCLTPTGLPGHALNGE

SEQ ID NO: 43467 - protein, 173 aa, A.fumigatus
YGEIVDIRFPSLKYNTHRRFCYVQFKSSGDAHNATRLNGTRVGSDLSLVVKISDPTRREDRHGPVYEGREIHISNIDWKANEDDLKEVFQKYGTIETVRIPRKVDGGSKGFGYIVFSTKVCLVAIRLLSFMTDLSHRRRQKPPLLCMNRNSARGRYRYESRPPKVPNELQPLS

SEQ ID NO: 43468 - protein, 279 aa, A.fumigatus
  UNSURE (18),(249): Identity of amino acid sequences at the above locations are unknown.
AIRSEILSSPGRVRLLAXRRKSEPPTHHKLNEEALNTWVYPTNLGKTRDYQFNIAQRGLFHNLLVALPTGLGKTFIAATIMLNWYRWTKSAQIIFVAPTKPLVAQQISACFQVAGIPRSETTMLTGEAAPGIRAEEWKSKRVFFMTPQTLVNDLKSGIADPKRIVLLVVDEAHRATGGYAYVEVVKFLKRYYKSFRVLALTATPGSTVESVQAIIDDLGIAKVEIRHEQSLDIREYVHAPEHRSANVPXIPTKMVLCMGTFQQGPCPPLVRTTSRNLKR

SEQ ID NO: 43469 - protein, 184 aa, A.fumigatus
IYALLALCCGVSSSLEFSPLCLLPVPLTQYQGLAVFFLISRSSIPIPENIGSKLSPANYKDTISQSDKAHNDAPPKPPVKETPGSANTAPVGRVNATFVTLARNSDVWDIAKSIRQVEDRFNRNYHYDWVFLNDKPFDDTFKKVTTSLVSGKTFYGEIPKEHWSYPDWIDQEKGLHHGAGRNRA

SEQ ID NO: 43470 - protein, 177 aa, A.fumigatus
YGLFGVTWAIAGALGPIIGGAFTTAVTWRWCFYLNCTYNLVDLWRNQADLLSTCRWRLVRNPRLLPQARIRWHAAVRRPPSYRLVRHCSHHRRHTHVPLRAGVRRYQLPLGLGHSHLPDHLRRSGLGPSDAERVETRQVSSDSRATFQKLAQSSRPYRLLPPGLVFTIGGWTDQRLK

SEQ ID NO: 43471 - protein, 141 aa, A.fumigatus
TVRIISLTCGGIKLICSVPVGGVSFAILVFFLKLESGGTPLFEGLRAIDWSGTVLIIGGTLMFLFGLEFGGINYPWASATVICLIIFGVVVWVLAMLNEWKLAKYPLIPVRLFKNWHNRLVLIVCFRQALFSPSADGPIND

SEQ ID NO: 43472 - protein, 247 aa, A.fumigatus
  UNSURE (32),(52),(68): Identity of amino acid sequences at the above locations are unknown.
GGVLLQVSVRIGPNHGLPFLSSQQNFSMSSPXDLTEKARSVFEAAKFRPCQXGQTCPAIQPNRPAPRXYGQFNIKQKGDPRKWFRVELHRKSELFWTAPNIPACTPDAEDPHYMLAKDARLPENSPRELLDRMNPTDYPVKIPTPNLYAEALAMLYYRDGVPGPTIRGDYWLDLQSELVQTGLVTLDELPARIKRHYELVRDADMKEVHRYSEEVAGQMRERFEVPVRMLPLDRDVFEPGAAAEEFL

SEQ ID NO: 43473 - protein, 92 aa, A.fumigatus
ACFFCQYSSLTLAMSDTKQPVGVQTSSAVPDAVTSPYFEPPKYNDPVTVNKNTGEDDSGSEAVADRIDTQKKGFWAYLSSTTGGRRHRAKSI

SEQ ID NO: 43474 - protein, 96 aa, A.fumigatus
  UNSURE (5): Identity of amino acid sequences at the above locations are unknown.
PLHVXHLPSTCLSPTKLSRRYELAAGVFLHNFASLTLVLQLLQEIEARAISSQQQIGVTKAQITAKQKNVRLLELTSKEIGSLSKDTKVYEGVGKM

SEQ ID NO: 43475 - protein, 323 aa, A.fumigatus
  UNSURE (34),(313),(314),(315),(316),(317),(318),(319),(320),(321): Identity of amino acid sequences at the above locations are unknown.
SELPPYFWKPSWPFSGYFTYKDRAFRKPKRSGSXQDPSPDASEIEAEIVHAAGSLEQPLGVYKLNSMLDSMFNSIGSTCARFQAITIVTSILLVGLLSLGWLRFAVETDPVRLWVSPTSPAAQEKEYFDANFGPFYRAEQVFVVNEHGPVLTYDTLSWWFDVESQIRRMISPGRGLLLDDVCFKPTGDACVVQSLTGYFGGSGWNLHPDTWEERIKHCANSPGDPSCLPDFQQPLKPEMILGGYEKSGNVLHAQALITTWVLNNHAQGTEGEADAIDWENNLKQLLYNVQEDAKERGLRVSFITEVSLEQGLXXXXXXXXXGT

SEQ ID NO: 43476 - protein, 279 aa, A.fumigatus
  UNSURE (21),(56),(101),(148),(277),(279): Identity of amino acid sequences at the above locations are unknown.
GKGTLVGRPGTLKLKSIPILXDLRCGGGSISRPKFVLERGLISGRADTKERPFKCXKCRRTFVRRDLLFRHDRTVHAKDGGIPLVAEGRRRGGAGVQKSSXAPAPSKPSITIDPTTLEQLEASSDGMVDLEAAAMLMTDFQHKAAAAXTGQVHDRAESDRSFSPGRGSLMEPSSAYLSGNATLPQMPWDTLVSPADMKHHMMNPTFVSQGNASDLRQLPNVLDRGDTLAPSLHSLVSSLPMSGNSTPNALSPFPSMTGPVSPVNVFTTGLEGNALPXGX

SEQ ID NO: 43477 - protein, 140 aa, A.fumigatus
  UNSURE (53),(98): Identity of amino acid sequences at the above locations are unknown.
LTTTFTAPASCVTATGNYLIGLNTTVPVWEYAVQCSTLGYTGCIPTGTASLPXTLNDNPNTIATQVYFSPGLYCPAGWATRGVAVRDANNGLSASGIXSARPTPTPTVSIPTAAPQWENPATLLMGLLDPSETLVMCCPE

SEQ ID NO: 43478 - protein, 70 aa, A.fumigatus
QPNHFTDDDDDDHDNLEPISEANIISGGRRTRGKTIDFQEAAEKLKAEDEMDDEDDDDEEFQPNDEDMRD

SEQ ID NO: 43479 - protein, 161 aa, A.fumigatus
  UNSURE (136),(139): Identity of amino acid sequences at the above locations are unknown.
IHSADSSTPCGRIHKGIRTTAADYITKEYHRNNVTIQTDTTVDRVVLEQGPDGLRATSVITQLADGTPRTFHARKEIIVSGGAYCSPAILMRSGIGARAELDQHGIPCQVDLPGVGKNLLDHLVSPSPFPPPPPHXFCXFLSLYIPFLLILSLSFSTPHTF

SEQ ID NO: 43480 - protein, 80 aa, A.fumigatus
  UNSURE (19),(22): Identity of amino acid sequences at the above locations are unknown.
EPPGPPRKSQPISPPPPPXFLXFFIPLYPFPPYPFSFFFDSSHLLGSTYPISLLSPATLSFSPLSLLFSLFPSLPSRRSP

SEQ ID NO: 43481 - protein, 61 aa, A.fumigatus
RRSKRRAATREMLESDLYAQQATYNANGESRIRWTPTTLRSDPLACSLRFAAAIKLSARRS

SEQ ID NO: 43482 - protein, 121 aa, A.fumigatus
LCCCPYQPDMGYPRHRMFPLTRENAVSNVDVQGNFLTWHRYFTWAYEQALRNECGYTGYQPYWAWNKYADDPRNSPIFDGSDYSMSGDGSYIPHDGSEAAPGIVLTPGNGGGCVFSGPFKK

SEQ ID NO: 43483 - protein, 63 aa, A.fumigatus
RWMCRGSLSKRERKEYTDAVLCLASKPSKLDPAFAPGARSRYDDFVAVHINQTWVIHGTVCFH

SEQ ID NO: 43484 - protein, 300 aa, A.fumigatus
  UNSURE (93),(290),(297),(298): Identity of amino acid sequences at the above locations are unknown.
RDRNNPQRELFQTVSLRTWIRISGLMVNHGFRTGAEALNIHYNLWGFFGDRFLTSNVDVEEDKKLKSIGNRYRAFQTRNGLRIVAFGVTVNDXILRDLNHTEVHNASWIFEQEWFAEAMKKEADIYVIVGHIPTYASCLDPTKDNPMVCLRDRIRNSTDKPIQLFGGHAHHRNFTCYDDRSSGIDSGKYCDTVGWVALNNVLSPTWSGTKELLGDDLHPNKSCAVGRQGDTHDAPYLLDRRYLDWNRVTFAYHTVNLEGNTDNPSVPASFDMPLGRKVTDAISKARSTRXGWKVPRXXKI

SEQ ID NO: 43485 - protein, 207 aa, A.fumigatus
MAVRPGVLSIPLETWGPADYFSGNSKEPQRDAEKLPPLPRDTIGCAAPDDTGIWSMTVHFGWVWSKVRTYVSDCANNRVREPWRHESMYSMVLSDLTEIENQTPLCHRYDHVRFYDRQPDELIVNRAYWIPWLKLQFMYHAILTVLNHPFLYIMASRHNPNLAIPNSFWRRSSELVLLHATWIVRMIDMLSDKDGFHHGGRPSALSK

SEQ ID NO: 43486 - protein, 96 aa, A.fumigatus
  UNSURE (85),(86),(87),(88),(89),(90),(91),(92),(93): Identity of amino acid sequences at the above locations are unknown.
SPTGASTRSPFPMSLPASTCSVLRSSPCTRVTARVAPNSTWSVSRSRSPLPAPRPSLPVFPFPVPTRPPTQVFSSTCTTPSPASXXXXXXXXXGRY

SEQ ID NO: 43487 - protein, 300 aa, A.fumigatus
  UNSURE (53),(61),(290),(291),(292),(293),(294),(295),(296),(297),(298): Identity of amino acid sequences at the above locations are unknown.
MLWSPLRTSASYPPLLFSLLPPFLHVLFNAWIVQHPFLHRFSFLLLSQFVMHXSHSLQFKXSFKMKSTFGLLALAAAAKLVSAHATVHAVWINDVDQGAGNSADGYIRSPPNNSPITDVTSTDMTCNVNGKNPVAKTLSVKAGDKVTFEWHHDTRSDSDDIIASSHMGPVMVYMAPTEKGTAGNGWVKIAEEGYSNGKWAVANLIANRGKHSITVPDVPAGEYLLRPEIIALHEGNRQGGAQFYMECVQVKVTSAGTKTLPAGVSIPGAYKATDPGVLFDMYNSFTSVFXXXXXXXXXAL

SEQ ID NO: 43488 - protein, 60 aa, A.fumigatus
  UNSURE (55): Identity of amino acid sequences at the above locations are unknown.
FSEFNSIFCFEEVLTTQPVHCLGCRHVLHCWCIEKWFMRFHNTCPVCHRTICSDXTVDIV

SEQ ID NO: 43489 - protein, 69 aa, A.fumigatus
DSRIDLFPYPCIRRVHLIHVDSAVRTIYNGPSPPFHFTFGLQHAIASVDGLRISGMISLSDGSKHYILE

SEQ ID NO: 43490 - protein, 155 aa, A.fumigatus
RYVLTQFRQQGSEGLEEYANASLDYASHDGTAIRDYIHILDLADGHLKALNYLRANNPGVRAWNLGTGKGSTVYEMIRAFSAAVGRDLPYEVAPRRAGDVFNLTSNPTRANKELGWKAQRTLEQACEDLWRWTKNNPQGYRQQRLTAGARLNAWY

SEQ ID NO: 43491 - protein, 96 aa, A.fumigatus
SYQHSFPDKQLFRLDQSIITMYQPLLLLPLLLTSAFATPHDPTTHHALEKRASFPIPSSKGIVTYSSPKNISGTFDCGLKNYRRGVKCTGHKRKLL

SEQ ID NO: 43492 - protein, 62 aa, A.fumigatus
CWMANYKLAFPNITSLTSFNASSAKTTMFRSRSVPHPVSTSRVNVPCGVDTANATYPLPVDH

SEQ ID NO: 43493 - protein, 66 aa, A.fumigatus
NQLYTLESRIAFAGWTQSHIDSYQGPTPDIVAGLAQHVRNTLQPTYTVAESGTAGPTGGATRNRTP

SEQ ID NO: 43494 - protein, 67 aa, A.fumigatus
  UNSURE (5): Identity of amino acid sequences at the above locations are unknown.
AGHVXDMLFQGVVKIFLQVRSVHPPDNITLHTPTVATDATDASSQAVAHLLTLTFLSIISCDITVLK

SEQ ID NO: 43495 - protein, 186 aa, A.fumigatus
TCPAECDYTCRHVVTDRRLARDPPMLNPVVQFHGKWPFRRILGMQEPFSVLLSLINIIAHWNGIGRIKETVPAWHSLRPYYLTFGYCGLACWTFSMLFHTRDFPLTEKLDYFGAGANVMYGLYLAIIRILRLDQGKPRYKPTLRRLTTTICVLLYTMHVCYISFWSWEYTYSLLPRGDRHPRKGGE

SEQ ID NO: 43496 - protein, 69 aa, A.fumigatus
TPSMQIPGPSRRRRLHLDLGAAQNNESVLISSKYPTRRKSAVSTYVVIARAARSIRIAATADKTGAWAR

SEQ ID NO: 43497 - protein, 73 aa, A.fumigatus
  UNSURE (18),(62),(68): Identity of amino acid sequences at the above locations are unknown.
DPGQVLRPHVEHRHNVKXQAKKGHDLGMMGVLIHVLGDAANNLGGYIAALVVWKANMRGDTXPNLLSXWRMRS

SEQ ID NO: 43498 - protein, 95 aa, A.fumigatus
SCGLHCRAGGAQGSRAPSCLTVESKLKSQISQRSKHPKELSFGWQRAQLLGAFFNGVFLLSLGISIFLQSIDRFVSLERTVYRPGGGNVTDTCRN

SEQ ID NO: 43499 - protein, 86 aa, A.fumigatus
PSLLVSCVQIYITGKSTASPVSKALLTPSQTINARNPSSPEHLGGSLPAITSTKCASCKSNGAAFWSTSNLSTANCSVQLFSARPS

SEQ ID NO: 43500 - protein, 211 aa, A.fumigatus
  UNSURE (1),(15),(35),(102): Identity of amino acid sequences at the above locations are unknown.
XLSRRLISGGRTEWXLSIPSGGVIPINLVHDMDTXQYLFGPITRVHAERTPRQRANPPHEVEEGAALILRFASGVVGTFIVCDATPSPHNFEMGTGENPLIXGPPGASEGGGGADFYRIFGSEACLSVPDMTRWSYDGRAEKSWTEQLAVERFEVDQKAAPFDLQLAHFVEVIAGREPPRCSGEDGLRALMVCEGVRRALETGEAVDLPVI

SEQ ID NO: 43501 - protein, 146 aa, A.fumigatus
IPSRIMHLLQCLLSTISLASTVTAFVLYSFNLEVSTEGPPSNDVARRFVPWKLLLDDSYNNHGSSSNGVSLTLDLKKFPVRRDNKYKVVLADEPTTPNTAALNQEGLDYSYFATVRVGSQGQQMWLVLDTGGPNTWFFGSDCTPVS

SEQ ID NO: 43502 - protein, 76 aa, A.fumigatus
KESARRRGFNSGHRLPSGHVNIFQVAIVLSGFDDKDFDIRILRKTGRDYTARGSSTANGELEPARGILADDIRTHR

SEQ ID NO: 43503 - protein, 86 aa, A.fumigatus
TLASWLTPSRWSNNFDSETDWNLITKPMPGVHNRQVKLSRGRFLGGSSGCNGPLCIRGAQQDYDDWELEGWSGEEFFAAMRKASSG

SEQ ID NO: 43504 - protein, 178 aa, A.fumigatus
TLYISALGTSRELEAGQLAAETANESKTLFIANISHELKTPLNGILGMCTVCMSEDDLPRIKKSLQVVYKSGDLLLHLLNDLLTFSKNQIDQAIRLEEREFRLSDIRSQLAVIFQNHVQEKHIDFNVNFVSDDTLPPQADGFHEKTSLPAAPALGPPGTGRLRDMVLWGDQHRILQVL

SEQ ID NO: 43505 - protein, 81 aa, A.fumigatus
WRGFLQPRGEDSRPIYSQLSFILFTLALEAHTGKNYSQILDETIDEPLDLVNSGVSPGATQRAAVPPGLSGWGAAVSTFGN

SEQ ID NO: 43506 - protein, 63 aa, A.fumigatus
KPVVREGPPRPEPGSPAKSPVKAGGGSPKKGFLDEKPPRLELALDLPSNNPVSQKGDNLSNWL

SEQ ID NO: 43507 - protein, 89 aa, A.fumigatus
SCHRVVKTEDDLVLAEFYAPWCGHCKALAPKYEEAATELKGKNIPLVKVDCTEEEDLCKENGVEGYPTLKIFRGPDSSKPYQGARQADS

SEQ ID NO: 43508 - protein, 181 aa, A.fumigatus
TTTRSDMLIQVQGRVDITRTFDGRELNNEYIFGLFSDPDHLSLVGVPIAYSITQFTANDDIASATTVVTFNSTSFNIIIPVTIDTWIEWDAQKKILQYDATFRWFGPLLDALLKAQAARMNTTDPVVVQAALTQLLADTICQTHEDHCKGEYQQYESRDACMDFVPNKSLHQGAGRIRALR

SEQ ID NO: 43509 - protein, 64 aa, A.fumigatus
PSSAAVLRGMLHQLVLRQISENSEIGGGDVPTSSKQGTGDLYLPQIYEFLLSSKLLNAHSLSPI

SEQ ID NO: 43510 - protein, 76 aa, A.fumigatus
TLIFQPGGEDASAPHLRVSAAKNQGDRSSTDTQPSARIPPPEQSAVEDKFFWTYTEEPHRSRRQAIIKAHPEVGIL

SEQ ID NO: 43511 - protein, 60 aa, A.fumigatus
GQGLSILLTKEMINPFLPLIKSSTPDPPLRTPKICQMCSTVYSKYLQRIPTQNRHFRNSY

SEQ ID NO: 43512 - protein, 230 aa, A.fumigatus
  UNSURE (194),(209),(210): Identity of amino acid sequences at the above locations are unknown.
NAIAFLPARGEDLDMADYGDIDAFARRCCDLDRIDYVILNAAMQSSIFKRRHKAGHELVFQVDYLSTALLCMLLASVLKDQSRVGAVTKPPVLTVVGSDTMYLSKFQAAGPISPRMDDPTGYDRMRQYMDSKLLLMVFVRQLARQVNPDDVVINVCNPGMVAGTGLGKNGKPNPSFAEKDVVPVFVKALGRKVXSGASVYVHALLAEGXXSHGSFISDWTIKPYAGVDVY

SEQ ID NO: 43513 - protein, 106 aa, A.fumigatus
PAGQDFPNNDNDNRRMWRDYLPHTQYLTDSAEFQAYQADHDDFLARIGSCLQSDGRYGKAEIIFRNALEIRERACGLDHPDTLASISQLGSVLDNQGKYEEAEAMH

SEQ ID NO: 43514 - protein, 146 aa, A.fumigatus
  UNSURE (145): Identity of amino acid sequences at the above locations are unknown.
SSLFLTGTGLFVGSGKVLSTGGPASVLIAYALIGCMLFCTVHALGEMAVLFPVAGSFAHYSTRFIDPAWGFAMGWNYALQWLIVLPLEIVAASITVDYWESNISNAAWVAIFWAVIVSINLFGVKGYGEAEFVFSLIKVIAVIGXM

SEQ ID NO: 43515 - protein, 103 aa, A.fumigatus
  UNSURE (5),(11): Identity of amino acid sequences at the above locations are unknown.
PHSRXSSLGKXYSLGYPAASVDWFLQQHTAFYIHLWNYFNAFPEEVARYTEVEKVGGLARVTRLQTLLTDALHSTSEVGAPSPIVPWFTVCSLCKVRPGWMCR

SEQ ID NO: 43516 - protein, 103 aa, A.fumigatus
VARRGRGPSSPVVKTTPEKFDMREKIELIQRSFHPVVEFGRDFSVILQNMGKSLYQRGPNTHDLIGLYVADTQMTAALLTTKWKSYQSLFFGLRHALYLSAEF

SEQ ID NO: 43517 - protein, 183 aa, A.fumigatus
NTPSSDLNYLPSSRSHAHCCQALHNQVTPEKALKSQTRRRKNRSPLRRFKDLCLKHTWVLPLLLMSVILLAYAVNPTPANPFHSAIFLSYPQPPKTPGGPVMYGKGPLDFAFVGFYTIVLSFTREFLMQCVIRPWAGYCGIRGRGKTARFMEQVYTAMYFAIFGPFGLYVMKQTDIWYFNTTG

SEQ ID NO: 43518 - protein, 180 aa, A.fumigatus
FVNTFPQRHALVIFGEAHGRETWDSSVDVTRTIGWFTTLWPVVAQVNPSDSLETVARTVRQARRAMDMHGWTHFTSVYHNTRQTKRSAGAHLMEITFNYAGKFQQVEQDGSLFRMEPMAKQNLLDGAAELGRWAMLEINSVILNGLLEFHVPYNRGTDEARPVTPWLVNASARQNWKETR

SEQ ID NO: 43519 - protein, 102 aa, A.fumigatus
  UNSURE (39): Identity of amino acid sequences at the above locations are unknown.
IKVPRVCHGTCISKSNKKQHQNYARRPSPKRHKPVRMSXPRISPCSPPPRREPSSEGIPGGFFSPLSSSIYFPALDTIASSLQVSITKINLTVTTYLVCIVK

SEQ ID NO: 43520 - protein, 185 aa, A.fumigatus
LLQGASPMLIAGFSDKVGRRPAYIICFTIYIAANIGLSLQNSYAALMVLRCIQSAGSSGTVALSNGLVGDMITSAERGSYIAVASIGLMLGPSLSPIIGGLISQYLDWHWIFWFLLILSSVFFAILLLFLPETCRKVVGDGSVPPPPLNNNVSDIIRHRRRKRAGLAADQASIAGLHEGWKVIHR

SEQ ID NO: 43521 - protein, 74 aa, A.fumigatus
SMRPSSCIPFSVGLAVVAHAASPSTLEELCTVSYLQTVLPSSKFIQGITIDSDSLTTSVATNSTVSSVDYPTAT

SEQ ID NO: 43522 - protein, 202 aa, A.fumigatus
PVAVLPVPGEDAFIYVWNRCLGDYVGPLEELIALIPSQAESLVNGDSIDEPNLHANAAKMFPYLSFVLTGRIYPTGEEMDDAEATRAKTALYDYLFSGNQSGTSQAIGRFPSLHAMLKFDASSFMSMLNEAFEDSFLNDQEPDEIPAQGVSINRQYLISILFQVMTPTSFDSSDTIYLDMFVARNLPKYPQYILLSGTTLHQ

SEQ ID NO: 43523 - protein, 164 aa, A.fumigatus
CADIHCGRPSRGEDLFSSLPPGAEPPVVDDHSYYAEYHPQPPQNDDRIHWTKHTQRHPVSSFIPLPTPAPSAIPRVQYEFAKESWLGRRKRVNRQKAVKEAFTHAWKGYKQHAWMRDELSPLSARYRTTFAGWAATLVDALDTLVIMGMENEFKDALHAIESID

SEQ ID NO: 43524 - protein, 75 aa, A.fumigatus
YSGALFPAPMKHPFPGGAFFLSFRASFLNSLIRIFSTGAVLPRETRGSTGAVFPPPKGVFYKRLSSPMGIMGGAV

SEQ ID NO: 43525 - protein, 92 aa, A.fumigatus
  UNSURE (48),(65),(77),(80): Identity of amino acid sequences at the above locations are unknown.
GSVTSNFFIINREGWPILFYGDVLTLQFHMSEVYKLAPLLKSLGLKNXCISVCAKKKTSISEMPXEPSLELMTDFRXKAXGLSKYFSLSHRL

SEQ ID NO: 43526 - protein, 188 aa, A.fumigatus
  UNSURE (156): Identity of amino acid sequences at the above locations are unknown.
IWTSEGSWRHSKIFPAFDVLGFDSPNQFGRNHRDDIRPRLYRPDGGSHPEIWLARGKGVFVTGDFNIAKGELDAADATEPIRKGAMTEDEFIFAPARRVFNQILSDGRVIGQRDEERESPVIYDICRSIHPGGRGMYTCWEQRIIARPGNYGARIXYVLCSLDMQDWFSDSNIQEGLMVSPEVAQTLL

SEQ ID NO: 43527 - protein, 162 aa, A.fumigatus
  UNSURE (25),(26),(27),(44),(48),(59): Identity of amino acid sequences at the above locations are unknown.
RYKQTTTLPIMDGQRQQTYIPALPXXXATQPSQSHMLSLPPPPXRHLXTQPQGVMPPPXPGPPPGPPPGPGYGASKLANSQLQQQNNLGWQHNWARQALSQGFLPPPPPPPMVPTNQAYGRQTSFSVPNADGPITSATYVPGSNTFGAGVGMSSQQPGRIRI

SEQ ID NO: 43528 - protein, 175 aa, A.fumigatus
TPARTISINQMGMQATGISPEVLISIEDGDVYTEALAGTQLSESPEASLDPLDNKLHNDAKEVMEHVIAIKGSSRRLSPDCLPESIAFKDFMKVMPRGSVQHLFSHVRGRLRADCDGWDALPGLIANITVPGMPGPRNLEAIRCFEPEPRDIYCGACIMLVFTRELPEPAITVGI

SEQ ID NO: 43529 - protein, 229 aa, A.fumigatus
PKAGGNAVAANGAVPSLNDALTQAHGMGVLTGDPVVSVPHSLDDVSWRIGGCVAVHLSLVHAAKTPECLSLAVEALYEAVQDNWRNSEAMERENGYGILAAILRDKFGLGNSSATSRASSICSNLEERCALGLDLLRLTLKFVGYDFEHPNRSIITNPLAYRVLLVDLDIWRLGDSAQLSLYYSQFSTFAGESNYRRFNAKRLSSHAYVHTLSFAPSTSSPPAGGSTKN

SEQ ID NO: 43530 - protein, 88 aa, A.fumigatus
TAPTEKSYTSVLQMIRSSAYRPIQLLAFEPMCMNLCVFSGILLGILYLFFGAFELVFSHVYGFNLWQIGSSFLGILVGMMSAILTDPL

SEQ ID NO: 43531 - protein, 221 aa, A.fumigatus
  UNSURE (1),(3),(21),(70),(221): Identity of amino acid sequences at the above locations are unknown.
XTXTPSPKSTDTMISIGTHRXYLSISGPPRHNPPDPIVVFIAGAGDVASSYCAVQRLVAPFSPLVLYDRXGLGRSESNPNAPSPTAMSAAAELHTLLKTANIPPPLILAAHSYGAIIAREYLHSYSSDVAGMVLMDASTERNIELFQNPDLDLSAMIGNLKFSEVTGLRAAAQLSREEWRVRAIDTARGVATSQAEAMVREEVCRALAEKEQFKKQALGEX

SEQ ID NO: 43532 - protein, 62 aa, A.fumigatus
RLRRVLIATVFYTFPHPFFYDLRPSFMEMEDLEKHRSSSFSPNEDANKSTPLLSDYGNKGKP

SEQ ID NO: 43533 - protein, 132 aa, A.fumigatus
  UNSURE (77),(87): Identity of amino acid sequences at the above locations are unknown.
LIVDFSAVDWSAFVDTIPAMFALTFFGVLHVPINVPALGISTGEENLSVDRELIAHGVTNALSSFAGSIQVRLNNLXGIIRFIYSCXSKTTLYSLINLPFHPHTVGIPLLGRYHAPPLVTKGFPVFGPGENL

SEQ ID NO: 43534 - protein, 175 aa, A.fumigatus
TRYFQFRGRSSEDNPKSVLATTILAFSASSVLTGLVFFLMGTCKLGSLIGFFPRHILIGCIGGVGFFLMQTGVEVSARLSGSLELNGPTLQKLFHMDTFLLWMIPLFLAIAFLVLKRFVRSNFLVGGYFVTVGVVFYIVKFGARVSMDTLRSRGWVFDAPSSSNPWYHFYTLYGG

SEQ ID NO: 43535 - protein, 180 aa, A.fumigatus
YSYLEAVVKIKALNGSPGYINLLDALNAWALVKELKQALGYPAAASFKHVSPAGAAVGVPLSEKERKVYMVDDIAGIETSGLAQAYARARGADRMSSFGDLLALSDVCDVPTAKIISREVSDGVIAAGYTPEALEILSKKKGGKYLVLQMDKNYVPASEETRTIYGVQLSQQRNDVVISP

SEQ ID NO: 43536 - protein, 201 aa, A.fumigatus
  UNSURE (121): Identity of amino acid sequences at the above locations are unknown.
ITLNALPCSPVVKKMYILPDLSSMGNEKNTPRMIHQLNTIPPFLDQSGAQRTELEKKKKKKKKKKKKRTKITAIGQFVQKGMKKTNHKRTRPAPKTVDRSVTAPTTTGAMVRLGTVRPAAXPLEKVEVPLLLLPLAKPYPGSAVAVDGVPRSWLQVPEKQGPCQPPPVHLLLGRAREWQKNLLGQVPLGTFLPGQGWAHHS

SEQ ID NO: 43537 - protein, 97 aa, A.fumigatus
  UNSURE (64): Identity of amino acid sequences at the above locations are unknown.
PRRFFCHSRARPRSKWTGGGWQGPCFSGTCSQDRGTPSTATAEPGYGFANGSSSSGTSTFSKGXAAGLTVPSLTMAPVVVGAVTLLSTVFGAGLVLL

SEQ ID NO: 43538 - protein, 179 aa, A.fumigatus
  UNSURE (28),(48),(49),(61),(62),(170): Identity of amino acid sequences at the above locations are unknown.
FQRETRQTTKPTNESSIRTEYKMTQSIXTTTQDGITTITINRPHRRNXXDPPTAKAFYNAXXAFDADPAQKICILTGAGGTFCAGADLHAVAAAGTGSSPSTLSTQENLQPVPVASGKNEQVPSLGPMGPTRLHLSKPLIAAIAGHAVAGGLELAQLADLRVGAEDAVCXKQTAWKEII

SEQ ID NO: 43539 - protein, 154 aa, A.fumigatus
VPPHKTYICGESAIVTRSIAPDCRLTTSTTILSYPIPDPADFMDFISEISAPSLAVASALTVAAGAYLNAKLAISTDLTTICNDRDWTKRLGQRIAELGDTATLYKMLERVVEVQGRGDSEALWFENKTWTYRQLKDRASGPYCYKHVLSPVRN

SEQ ID NO: 43540 - protein, 140 aa, A.fumigatus
VLRIQSTANLSLLQTSVDLVAAAAVVTVMMTDVDLTVAAGVAAAVVVTTTVMVVMTPTVIVVTMAVVAMAAANTATILVVSTVTTTATVVALIATPPVVVVAVKSGTVASLAVTIVVAIMIVMLTLPATATPLLPANRTL

SEQ ID NO: 43541 - protein, 136 aa, A.fumigatus
ASVRFAGRRGVAVAGRVSITIIIATTIVTARLATVPLFTATTTTGGVAINATTVAVVVTVLTTRIVAVFAAAIATTAIVTTITVGVITTITVVVTTTAAATPAATVRSTSVIITVTTAAAATRSTEVCRRDKLAVD

SEQ ID NO: 43542 - protein, 110 aa, A.fumigatus
HHDHNSHDDRHGEARDCTALHGHHHYRRRSDQCHHGSCSRHGTHDEDSRGIRGRHRDHRHSHDDHCRSHNDHNGSRHHHRRRDASRHREVHVCHHNGHHGRRGHQVHGSL

SEQ ID NO: 43543 - protein, 155 aa, A.fumigatus
  UNSURE (5),(152): Identity of amino acid sequences at the above locations are unknown.
SGMLXERLQQLTYQVGSSSPLPHPFDPLSTKEIDAAVAIIRKEHGNVNFNAVTLYEPRKAEMMAWLADPENAPRPARAADVVVIAPGGKVYDGIVDLDQKKIVSWKHTPGVQPLITMEDLQEVEHIVRKDPKVIEQCAILGIPEVAHHGAEXSRD

SEQ ID NO: 43544 - protein, 80 aa, A.fumigatus
PYLSGVFAGSLFWVGVTYIFSVLPGRYTLPRYCSVLTVYALSNLFHVANFEYIVRGVLLPHNIFLHLLDDRRPRLCSEDG

SEQ ID NO: 43545 - protein, 78 aa, A.fumigatus
CSSTSYPFPFTMAEFSTSEDLFAHARGNESNERFYNLCFWGRNNPPSAMPCSQYTTQFISSRGNEYFCEIDEEYLTDR

SEQ ID NO: 43546 - protein, 65 aa, A.fumigatus
YYARMSASSILDKPLLKVSRPVAACSRCRTAKIKCDGKLPACSACERVWKASTCSGASDEFARGK

SEQ ID NO: 43547 - protein, 156 aa, A.fumigatus
  UNSURE (139),(148),(153),(155),(156): Identity of amino acid sequences at the above locations are unknown.
KSVSMSKHNLTDTTVIHRGQYKYRKYSHSNIPISHLSPLPRQQPLPLPLHPLNHLARRPITQPKHRHSRHRSQQPKSPRHRIPPKLILNKPTPKRTQEHPHKRGHSLDAERLRHGPSFAEDPRPRALHFLEDLLRFDVXRGHASVDKXADKGXGXX

SEQ ID NO: 43548 - protein, 247 aa, A.fumigatus
  UNSURE (12),(202),(224): Identity of amino acid sequences at the above locations are unknown.
DTLSSEPAGEDXRVSLQSHDDITYESIAKAFNLPLKLHTRAFERMKRLSKPHPMQPHFDWDTPSPGLTAKLRMVYLPYDENLPAESQALFVADDMWVPIAVVNGNVHILPGVPRLFERLLEHLKPVLLPRLANPEGKGIYRYLFSTPLPESAVAPYLTDLAARASVHGVKVGSYPRWGNKRNTVTLVGKDKAFMDSVIADVXENVQGKKVSRDDELDPPSESEXSSNDSLCSFTGKIFCVFNLLTDR

SEQ ID NO: 43549 - protein, 179 aa, A.fumigatus
  UNSURE (170): Identity of amino acid sequences at the above locations are unknown.
EMSSNDPHLPPSDIASPGIKDEAASVTLGSLQEPQQQSQTPAGSFSEPVENAAVPATQSGAVNTQKYDNADSTQAAGVHDSSTPIVAAEQSIRDTFATNDKPQDTTGLESTDTPVPEPLPDASDAAAKEVEGSAPSLTITLLLTTGSRHPFEIDGKYLQKRGSTSRVLIXGGWDRHSMD

SEQ ID NO: 43550 - protein, 162 aa, A.fumigatus
YLCADPASPVVKTIDMKVTRDSESGIDIDLHDRSELSEVDLAIVRIDPVTYLPPEIMSLTLSYLDPESLMQAELVSRAWREQASSRHTWRQVFRRAYGHRHPSGVASKKRQSAGLGKSIPNQEWKKMFLVRRALDHRWKEGKAAAIYLHGHTDSVYCVQFDE

SEQ ID NO: 43551 - protein, 185 aa, A.fumigatus
RVSFQPRGEDLQQFYRESRLHHLSTWKAELKAQLQAAAKEKSHSQAGRKKPAPGARRYVLHVDFDSFFAAVSMLKHPELKGQPVAIAHGTGSGSEIASCNYPARARGIRNGMWMKGALQACPELKVLPYDFPAYEEASKKFYSAVLAVDGVVQSVSIDEALVDITLQCLEAGGSDGRGISERSIY

SEQ ID NO: 43552 - protein, 121 aa, A.fumigatus
LHLPSEQVSSSNPLVKPKPTPGYIYLYSEDELVHFCWRPRTAPPDQPELDLVMVPSDGTFTPYQPAGKDAPTNGRIFVLKFSSSSQRYLFWLQSKSQHERGDPSWFSPIFTTGLEGNAYGE

SEQ ID NO: 43553 - protein, 66 aa, A.fumigatus
  UNSURE (25): Identity of amino acid sequences at the above locations are unknown.
TFAMSIAPLITFKAGICDLDVSDCXYSPDKLTLTSVYQTATIRPDNRFMALTNSTFPLSRCQVPIH

SEQ ID NO: 43554 - protein, 205 aa, A.fumigatus
  UNSURE (194),(195),(196),(197),(198),(199),(200),(201),(202),(203),(204): Identity of amino acid sequences at the above locations are unknown.
GKYDANANQWIMGLNAALKDWKRQTKYFGHLNGSKYSCLVFDNRGVGRSDKPTCFYSTSEMARDVVDLVSSLGWIDMKAPATRAIHVIGASMGGMIAQEVAMLIPDRLASLTLCCTAPRLVRTTPFFENLQQRASMFIPRHVDVEIDRIAATLFASEFLAQPDTENEDPALNFPTKRDRFAAGHLRKKADTESXXXXXXXXXXXQ

SEQ ID NO: 43555 - protein, 183 aa, A.fumigatus
  UNSURE (110),(166),(179): Identity of amino acid sequences at the above locations are unknown.
PSSPGGVRRNTWHLPLWRKCIILVVVSWMAFVVTFSSTSLLPATPEIAAEFDTTPEILNIINAGVLLAMGFSSLIWGPFTALLGRRVAYNIAIAALCGCSVGTALAGGSXVFAVFRVLGGLTGTSFMVQGQTILADIFEAVCMIVYLSGCVCVCECDKADCGVKGXGDGGWVLHGWDGXGAGD

SEQ ID NO: 43556 - protein, 188 aa, A.fumigatus
  UNSURE (5),(18),(74): Identity of amino acid sequences at the above locations are unknown.
IAGPXTVPAMKNPTAVPXTFYTTISFITLTHAHTAREINDHTYRLKNIRQDSLPLHHKRRPRQPPKHPKHRKHXTPPRKRRAHRTPAKRRNRNIIRNPPPKKRSEGAPNKRREAHGQQHPGVDDIQYFGGCVELGCDFGGCGEERRAGEGDHESHPADDDEDDAFAPEWEMPCISSYTTGAGRSRVRQ

SEQ ID NO: 43557 - protein, 112 aa, A.fumigatus
PIGGHGSNKALLEIFGKNGPFTACKGCRNIYTKLAIAIYIDHGKVGERAVGCPWHWAVALLWEIKLVDCPIVATKRYAYRWPLLARHAIIGQQLMMLLGSWLGCWIHCANRP

SEQ ID NO: 43558 - protein, 180 aa, A.fumigatus
  UNSURE (123): Identity of amino acid sequences at the above locations are unknown.
RSQLSGDNAEAFNSATRPLSQSIAVQTDATDPFVASTEPAPAPEPKREVVTYSKGVQTDDSKQRQTDSLDSESETGEFDDGTGPSKRLSKSDREHDEEIRRKLRREIEEELQATQQQAAGGPXAQATNLRYPLRTLDEDELKAVTSSEDFLDFVERSAKVIERALNEEYDVLADYELGGV

SEQ ID NO: 43559 - protein, 135 aa, A.fumigatus
  UNSURE (6): Identity of amino acid sequences at the above locations are unknown.
YSLARXVRPLWLKMLITCVLGIITYWWMVDFPEQSHRSFCFLSKIEAKVAAQRIQIDRDDVVPEPFSWRKILVNFLDPKLYGFACLFFLLNLVSTSLNYFLPIILQSGMGFSSSQSILLSTPVSSACHEVHDYPT

SEQ ID NO: 43560 - protein, 146 aa, A.fumigatus
  UNSURE (138): Identity of amino acid sequences at the above locations are unknown.
KLRELKRIKREREAIEAAEKEREEIERRRNLTAEEREREDREFIEKQKQEKEASRGQTGFMQRYFHKGAFFRDDLEREGLDKRNIMGQRFADDVARETLPEYMQIRDMTKLGKKGRTRYKDLRTEDTGRFGEGFVFTXWPWTDQSS

SEQ ID NO: 43561 - protein, 209 aa, A.fumigatus
GARFLPASGVIMISPLVRALEPISNFTVDTQVQLYATFSPTAPKPEYDEALAAWTLKKEDLSAFINAAEWPLSPSIGNGPTINFILYVPAPSQSPMVVKESGATSWIIPQWGGVFLVNPPLSTTQENHSSPTHLSKDALRAGFLTFSHQLLTLLGVPTTPTSLPFRLQTLIRVRAATLLLSASSTMGSLARLTESIPSIPIPANVAASV

SEQ ID NO: 43562 - protein, 93 aa, A.fumigatus
  UNSURE (82): Identity of amino acid sequences at the above locations are unknown.
TNTYDSVSELDASCLELTPECIKQAQDTKTPEDVKQFFRDYGEISDHFQPTPMKHSETVFAATRELRSTRSLTTTEKQDLIXTKYEDSRGDST

SEQ ID NO: 43563 - protein, 117 aa, A.fumigatus
  UNSURE (108): Identity of amino acid sequences at the above locations are unknown.
GSLLDLLIQAGLRSKWPVERETMWLAYRIFMLNFPGVHTSGISATSALLDILSYPTEEGLMDMLQAEIEQIAANSDGSWSAADLERASLLESAIKESLRFDGINALCXRDRAWKYSI

SEQ ID NO: 43564 - protein, 181 aa, A.fumigatus
  UNSURE (20): Identity of amino acid sequences at the above locations are unknown.
IGTIKPTMPYLVGIRRTLTXYVELLTWTNVERIPDPELAKRRDLRRSRKKRGVTLYECLDEFNKEEILSENDAWYCPRCKEHRRASKKFELWKTPDILVMHLKRFSASRGFRDKLDVLVDFPVEGLDMSGRVESPEEGKSLIYDLFAVDNHYGGLGGGHYTAYAKNFMSGQWNEYNGKSFL

SEQ ID NO: 43565 - protein, 76 aa, A.fumigatus
DEVHPAIVGISRIWTSGSSRRRGIAMDLLDCVVTNFIYGMEIPKEQVAFSQPTESGKRLAQAFFGPGVQWHVYNES

SEQ ID NO: 43566 - protein, 112 aa, A.fumigatus
LLSSEVDFADTNPLLKRPAETEHAFDTDKNQKPAPARPSINGKSHNWFARVFQIKPATRVVALNTSKLKGRKDVLKLLREWKQFGMEEAYLDKANGVIRAKVGEVNCKSEPG

SEQ ID NO: 43567 - protein, 69 aa, A.fumigatus
HECLSPAVRRSNGILAIFRATSSRGTSTKHQVSVEMKYVQLGSSGLRVSPICVGCMSYRSPEKRFDWAL

SEQ ID NO: 43568 - protein, 86 aa, A.fumigatus
  UNSURE (1),(2): Identity of amino acid sequences at the above locations are unknown.
XXSSLKSVILAWFLFWPGVLINIIVGAEVPHVTGQAYLDDKTVWRTWNNQTGWSSNGLFFVAGMLNGAYSVGTPDCFSHLAEEIPR

SEQ ID NO: 43569 - protein, 170 aa, A.fumigatus
  UNSURE (8): Identity of amino acid sequences at the above locations are unknown.
YRPSRNIXKAVLAQMSVGFVTGLLYMIAVFYSINDLDLVMSNPYGFPLAEIYRQATGTRSGSLGLLIVAFLPTVITCAGCYITAGRTLWTISRDKATPFSGWLGRINTRMHNPFNATLVCGVIITILACIYVGSTTAFNAFVGCFVQLSSLSYLAASFHNGVEIRHGYRH

SEQ ID NO: 43570 - protein, 80 aa, A.fumigatus
CSARTWIRSSKTSEITPLVKSKRANATLLSLGNIFSKLPNIQQDHQGAFSDSPLSSQTAELADEILSIKSMTQRYMSIWE

SEQ ID NO: 43571 - protein, 70 aa, A.fumigatus
RPFVLLIYSSVTTAFPGTHLRHHIISDGRHIGRTPYLLVSSLPLTSRVIPAAAILDLSYLYDIQKTVDTT

SEQ ID NO: 43572 - protein, 108 aa, A.fumigatus
NIPDEWLSAAMDAHELSFRDGHGSSTSTMKDGCASAEKPHYLPGDSSFTSVFGPSETVEDVETEPGSTQDKPHSFNTQKPIRENLAGKNVAPFLARHIPEQYAPLGSQ

SEQ ID NO: 43573 - protein, 162 aa, A.fumigatus
  UNSURE (26),(35),(37),(39),(79),(80),(83),(84),(140): Identity of amino acid sequences at the above locations are unknown.
ERGEQNQGRRGKQEEEGRAETGERQXERGKKHTDXGXEXTKRGGEENKEQRRAEKETKEGREPKGRRRKPPTQNGERGXXEEXXGHLPIQTPHSRVCQPAPFHPSYLHWHSIRHPEAYIDTSDTLLHTRNKPSNTYPQHXTPLQRNAFAIATPTLHRISWLV

SEQ ID NO: 43574 - protein, 161 aa, A.fumigatus
  UNSURE (26),(36),(38),(39),(79),(81),(83),(85),(141): Identity of amino acid sequences at the above locations are unknown.
ERGGNRTKGDGGSRKRKEERKPGNGXAREGKSTPTXEXXRRKEGGRRTKSKEERRKKRKKAENQKGEEGNHPHRTGKEXAXKXGXDTFPFKLPIPVFVNQPLFIHPTFIGIPFAILRPILILPIPFFTPAINLQIPTLNTXHRCNAMPSPSQLRHCIVLAG

SEQ ID NO: 43575 - protein, 155 aa, A.fumigatus
LWFGVLKCISRMYIPWSPTEAAWLFPYFLFPTTRTFPPPPPLSSLTTSIFSPFLSSSSAYSLCALFSSFSRFTSFSLSPSFSPSVSFSLLFLPSSSSLLLFLLFFFPLLTLRLPFFPSLSLSFLPPLASYSLVTLLHSPLILVHPTSISLSRSPI

SEQ ID NO: 43576 - protein, 146 aa, A.fumigatus
  UNSURE (20),(25),(27): Identity of amino acid sequences at the above locations are unknown.
ATMGYTFYLYISTHRTIIRXNDLTXEXFPTTTVSNYSTNNFTMNAVASAQPCLNDGQCHYAINWLSILAMRNTISPLVSGFGMLPVSNRPYFTSDTLRALYGGSGNLTQINGTFASIAAALTANARNRVCQGAVLGDAWTHVSYIR

SEQ ID NO: 43577 - protein, 150 aa, A.fumigatus
GGGICDGIARNATAGSYGAYSVCTSKDQLSYVFDRYYKSQKKAASACDFAGAASVQSPKGESADCKSLVSQAGSAGTGTVTSQPTGGSESTGGGGGGGGGGGGGGAAASTSTSKGAAAGAASPAAVRVGGWPLVTYGLVAAMAGILMISL

SEQ ID NO: 43578 - protein, 108 aa, A.fumigatus
PKKVLVLWLVATTDPSVISTFTIKIMKRKSAANFSDTGAKRAPRQDPVSCESCRRKKLKCNRQRPCSSCVTRRLSCSYGISLERIEPAIVEVENASLHHKARRIRERG

SEQ ID NO: 43579 - protein, 86 aa, A.fumigatus
  UNSURE (2): Identity of amino acid sequences at the above locations are unknown.
GXRERVSFQPRGEDIDDADVRALDEYVSEEQAMESALLEMAHVPFENTGRTHEANSSFSDEEEYDDIFMSLADQGPQSQDMDMSSG

SEQ ID NO: 43580 - protein, 147 aa, A.fumigatus
HIQILFNFPYTALPGPCGYRITTSEQNSCERQIVYTVVSHGISYKNVHGYGSNDVLVPYCIDRTTGCSGRINNYELRMRPSCWMQPWNVQPSFPPTAHRNILGGNKCSMSPYQSTDIRTQSQLPDRYLLSVSLQSTRLHHGRGSTAY

SEQ ID NO: 43581 - protein, 148 aa, A.fumigatus
DQQDIWTAASSRSSACKYLHTTTTITMATRIKLLPNPHYRKSGTKSYVHLMRKYRFTPTKGGRYFLSSSLHQTGRQYTHLPVGGRARIQHVLRKRIADTDETSDVGADDVQNDTMYLAPVSIGTPAQTIHLEVDTGSADLWVRHYASR

SEQ ID NO: 43582 - protein, 69 aa, A.fumigatus
TPMIRCIGYVSDSSSISWTAFFELALRLIRFLFYFYFPLNATQTFDSYLLHPLSRTQTNHPASFASESH

SEQ ID NO: 43583 - protein, 170 aa, A.fumigatus
LMSTDALDPENPDKKHYTKICGILINSLFSSNEYIAVVGIGINATNASPTTSLNALASRFVSNKSAPITLEKLLARCLTTFEELYTRFLRTGFDREFETIYYDDWLHMHQVVTLEEEGGARARIKGITRDYGLLLAEELGWDDRPTGRVWQLQSDSNSFDFFRGLVKKKV

SEQ ID NO: 43584 - protein, 189 aa, A.fumigatus
  UNSURE (1): Identity of amino acid sequences at the above locations are unknown.
XAILHSLETNMSYYHCCLSVAAIHLKASNGRSSDKIDHDIMRHRYEAVSQLCRALNSDNGHEQILDATLAMIVFHGSVGSLEDYLPDIPWNGHFQAGANLVNKLDLADTGPYTQPPFSMSLASWIDILGATMLRTTPYFSHTYRTKHLSGTSSGLRELMGCDDRIMYLISEIACLDSLKADGPIDDLAL

SEQ ID NO: 43585 - protein, 228 aa, A.fumigatus
  UNSURE (5),(21),(39),(40),(115): Identity of amino acid sequences at the above locations are unknown.
ARFSXTAICTTVPSPGAPAFXYAQQQVHHVLSSVVEKTXXYYLPPCELAKIVNATIEACDPLDGRTDGVVSRTDLCKLHFDLSKIIGEPYYCAAKTSTSLGFGFSKRQAAGSTTXYQPAQNGTVTKEGVAVAKAIYDGLHNTQGQRAYLSWQIASEFSDATTEWNNDTGSWELSIPSTGGEFVTKFVQLLDLDNLSTLDNVTYDTLVEWMNTAMVRYMSSPRGRKEPR

SEQ ID NO: 43586 - protein, 192 aa, A.fumigatus
  UNSURE (25),(41),(58),(60),(135): Identity of amino acid sequences at the above locations are unknown.
GCQDLHLLRRMLRRWTGRHEPGSAXRRFVRRCHHRVPRLSXMPSSRSTTSYRRLWRRXWXTTFPRANWPRSSTPPLRPAILSTAALTGWSPAPTFASCTLTFRRSSGSRTTAPQRPAPPSASASANARQPAARPXTSLHKTAPSPRRGWLSPRPFTTVCTTPRASAPTSPGRSPRNSPMPPPSGTMTPAPGS

SEQ ID NO: 43587 - protein, 108 aa, A.fumigatus
  UNSURE (57),(74),(91),(93): Identity of amino acid sequences at the above locations are unknown.
SNGTQSTFWLTRPWGRDQLSGKTLTRNFYVRSRDAKIYTYYEGCSDGGREGMSQVQXYGDLYDGAITGCPGFPXCPAAGPPRLIVGCGEDXGXLPSPVRTGQDRQRHH

SEQ ID NO: 43588 - protein, 313 aa, A.fumigatus
  UNSURE (214),(282),(298): Identity of amino acid sequences at the above locations are unknown.
ALGTPPVVDTTVAISSSQWPTDLKVKQLANFGPSPWIENLAVRHSGEVLATQMLDPRILQVDPDGKLPPIVIHSWAEGASAGKYDGVLGITETRHDEFYVAVAGQYDENMKLLPNSTNYIFRVDFDTLEVSSAGEVLSNATVVELTSLDGSQLVNGATTLNEDAILVSDSSNGWVYKVDVRTGAYDVIVDDPLMKKNSGAEWKAGVNGIKVFGXYLYWTNTDAGLLARIKINDDGKPCGVSEIVASNLTEADDFTLDDHRTPYFALGPLEKEIRRGSFLEGXQQAGHLLYWATHHQSXGPATLVNHHPTGPSL

SEQ ID NO: 43589 - protein, 156 aa, A.fumigatus
RTKRGTPSAPTELGGRRGIRGRKWVVLMVPGGIYESPGSWQGRIRSPIGESRRADSRRPDVHRFRIKVHAFEDTRYIMIGPTLEYSEFEAKIREKFGFRSLLRIRMQDEGDMITMVDQEDLDLLLSSATEAARKEGSEMGKMEVSPIPHVCETTRN

SEQ ID NO: 43590 - protein, 78 aa, A.fumigatus
LSRRLEPDFNKNIQLDVPVTCSGSFVFYTTFTPLPQFSVDPVPTPEPARTPDYYVDVAPRLTLRGKKLPLNALSIFSV

SEQ ID NO: 43591 - protein, 65 aa, A.fumigatus
APGAGFATRNPSQLNTLSTGISTPALVKYPRTRSTSPVVRHHTSNPALRNFSNAGTSSGRSCSDA

SEQ ID NO: 43592 - protein, 96 aa, A.fumigatus
RPPPSPPTPLQQPPSSPSQTPPSIPPPQAHRSMPPETPPSPQQTHPTDAPPQTTSHPPPQTQSSQSQPDKPPAPASQPATHHNSTPFQPASQPPPW

SEQ ID NO: 43593 - protein, 160 aa, A.fumigatus
VAQPRRFFTEEERDAFLAGYASLQLRPELVPALEKLRSAGFEVWCLTTGDVERVRGYFTRAGVEMPVERVLSCDGLRVAKPAPGAYRAAIETIGSGGEDEKWFAAAHLWDVSAAVRAGFRGAYCGVLEGEGCWEVFERESLEVVAEGLVEMVEGVIQLSG

SEQ ID NO: 43594 - protein, 124 aa, A.fumigatus
  UNSURE (122): Identity of amino acid sequences at the above locations are unknown.
QSSSTTNQSLELESRSKPKNLVLNHPYRSHKMQIKSFVLAASAAATASAAACQAPTNKYFGIVAIHSGSAVQYQPFSAAKSSIFAGLNSQNASCDRPDEKSATVHIPGWLLIQARPWKISIXPP

SEQ ID NO: 43595 - protein, 81 aa, A.fumigatus
  UNSURE (32),(67),(68): Identity of amino acid sequences at the above locations are unknown.
CGQNLLLQPSDCSVLDRQQMLVLYDPADDFEXGALTRMAVDNDFGELPDDTVCLPSRASSHCEKKNXXFLVVCGFSHRVVT

SEQ ID NO: 43596 - protein, 218 aa, A.fumigatus
  UNSURE (1),(36): Identity of amino acid sequences at the above locations are unknown.
XILLLAVTACTTRQTYSIIRQLPEVIVHSHPCQSTXFKVIRRVIEDEHLLAVKDRAVGWLKKEILAASAQSSNNATYIFLNPHYFSVLFPLLFNSADLLLNVSTDIAASWIQFSQTLAPSIHAALSLYYILLQSSTLRTQLQLEKTYPYFRSRFLEPLKTLCHAFETEMTQNGGDGRIEAAVGEEMSQIGMARSVGLISHVVERVEEERLHHGVEIAC

SEQ ID NO: 43597 - protein, 184 aa, A.fumigatus
DDIDDEQVIVRGFAGNAVRTERGIQYLGKRLAKYVLFMTYPDQPYRPLKQSRTKTFTESLGAWKTAKVSVINDPSGSRTRADEAEDEHRYYQITSISFIGHSLGGLVQTYAIAYIQKHSPEFFNLIRPVNFIALATPFLGLSNENPMYVRFALDLGLVGRTGQDLGLSWTAPRGLHDAAGKYTS

SEQ ID NO: 43598 - protein, 271 aa, A.fumigatus
  UNSURE (3),(4),(5),(6),(7),(8),(9),(10),(11),(12),(249): Identity of amino acid sequences at the above locations are unknown.
NIXXXXXXXXXXEDYSDQLAKDAYQSGAYDYMDIVALSARQVMGATTFSGTPDDPILFLKEISSNGNFQTIDVIFPSFPFFMYTNPRWLAYLLEPLIEHMLSGQYPNTYAMHDLGAHFPNATGHPDGRDEYMPVEECGNMLIMGLAMVNSLRYTNDSAASSIWSTLGVPPKVSEPHTGYFPLGELQALSGIDQQDGKWGGGAEGERLAEKWVQRSYRLWTQWTGYLVEYSLEPANQRKRNACIFPQALXLICVSLHGRFRRMARTADQPGN

SEQ ID NO: 43599 - protein, 170 aa, A.fumigatus
DWVTSNHESLHMVLLQFSDFGTMFNWRSLSGYMGHAYKWVMPNGSFKYVHIFLSSDRGPNFSQGEQAKDNSDLDPDHATRDLYEAIERRDYPTWTANVQVVDPAEAPDLGFNILDVTKHWNLGTYPKDLPKIPSRPFGKLTLNRIPDNFFAEVEQLALPPLPIWCPASCP

SEQ ID NO: 43600 - protein, 222 aa, A.fumigatus
  UNSURE (219): Identity of amino acid sequences at the above locations are unknown.
SFVTLCRLCTGAILAFTSICSTFDSAVFSSSTGNVARVFGVGVEVATLSSSLYILGYACGPLIWAPFSELQGRRLPILIGMLGFGIFNIAVAVAKDLQTLLICRFFCGVFGSCPLAVVAAIFSDIFDNRSRGIAIAMFSSMVFLGPLLAPFIGGFINMSYLGWRWTAYLPAIMGFAALILNFFFLKESYPPVILIYKAAELRRRTKNWGIHPHHDGNLXPPA

SEQ ID NO: 43601 - protein, 145 aa, A.fumigatus
NSGGTWSSNSSLTRVSTEAGDSRLTPPSPASTRKIPPPNLSPCTLCPPPYPCGSPSPPPAPPPPPLSPPRAHRLPHLPPPPPPLMTPSGPPPSPPPSPPPPPPPPPPPPPPPPPPPRARPPPPPPPPPPPPPPPPPPPPPPPPPP

SEQ ID NO: 43602 - protein, 175 aa, A.fumigatus
NIATEAHMISSRIRFDGEQLMSWWRPPLVELWRNLELELVPDEGLDRSRRQQVDPPIASEHPEDPPPQLIPLHTMSPPVPLRLPLPPTRPPAPPTLPPARPPPPPPPPPAPPPDDPLRTAPLPPPLPPPPPPPPPPPPPPPPPPPPRAPPPPPPPPPPPPPPPPPPPPPPPPPPP

SEQ ID NO: 43603 - protein, 252 aa, A.fumigatus
GGGGGGGGGGGGGGGGGGGGGGGGGGGRARGGGGGGGGGGGGGGGGGGGEGGGEGGGPEGVIRGGGGGGRWGRRWARGGESGGGGGAGGGEGEPQGYGGGHSVQGDKLGGGIFRVLAGDGGVNLLSPASVETLVRDEFELQVPPEFYKGGAPPRHKLLSIEPNTGRYHMRFRRDILADPPSDDPAANAAVAELNAILDKQDTVGQSFSEDVFKENVILLMDNARFLHCRTQIKDPRRFLRRIRFNGTPGARN

SEQ ID NO: 43604 - protein, 175 aa, A.fumigatus
GGGGGGGGGGGGGGGGGGGGGGGGGGGARGGGGGGGGGGGGGGGGGGGGRGGGRGAVLRGSSGGGAGGGGGGGGGRAGGRVGGAGGRVGGRGSRRGTGGDIVCRGISWGGGSSGCSLAMGGSTCCRRLRSRPSSGTSSSSKFLQSSTRGGRHQDISCSPSNRIRDDIICASVAIF

SEQ ID NO: 43605 - protein, 262 aa, A.fumigatus
  UNSURE (190): Identity of amino acid sequences at the above locations are unknown.
KVRTCLSRQLLPQDKDGDEDEDVDANFMFIEWNNQAQSNSTRKPMPEGGFGGLSRRSGKKPVICAVNGLCLGGGCEMVVNADIVVACLQAYFGLPEVHRGVVAIAGALPRLVRTVGRQRAMEMALTGRKVSAEEAKDWGFVNDVVDAAHHVVKRAVEISELIAANNPDAVVVNPERINFGWEGICAQNSXRLVVHTWANMLYEGENIKEGLPPFVQKRKPTLGGHQFCNMNSIAPGFFHFMPTNNELPPYKLTGEEKNFHPK

SEQ ID NO: 43606 - protein, 178 aa, A.fumigatus
  UNSURE (26): Identity of amino acid sequences at the above locations are unknown.
TKGGRPSLIFSPSYSILAQVWTTNRXLFCAQIPSQPKLMRSGFTTTASGLLAAISSEISTARFTTWCAASTTSLTNPQSFASSAETFRPVKAISIARCRPTVRTNRGNAPAMATTPRCTSGSPKYACRHATTISALTTISHPPPRHSPLTAQMTGFFPLRLDNPPKPPSGMGFRVLFD

SEQ ID NO: 43607 - protein, 92 aa, A.fumigatus
TLLPPVANPLRKFPPLGVLHPRLSSQIFQVTIMLMYPSVRKGLITEPTSAPFIHQQDPVCIQDDLFIPDFSQQDPTLQCFYVFTTGCKEGVR

SEQ ID NO: 43608 - protein, 187 aa, A.fumigatus
  UNSURE (73): Identity of amino acid sequences at the above locations are unknown.
TFSVSDPSTPVEKTSRDLGENLEAKFSDIFALFSKSIRDPESEEVRVNTLLALSKLAMHLDSEEDVGPVRAFXDIVPSMVAVLKDSIDQKQEDRVMQAFEVFQTLLGCDPALLTVHLKDLVIFMNELAANTEVDEDTRTQAISFLMQCVQYRKLKIQGMRIGEQLTRTALHIVTELGDTSSDDDDIT

SEQ ID NO: 43609 - protein, 63 aa, A.fumigatus
LECWSIWDQNGYSVSSLGVLDLMAYLRATERQDLPDINNLGRPASHFLIVGQMGLDPRWTKSG

SEQ ID NO: 43610 - protein, 60 aa, A.fumigatus
QNMFITRGIPLVNFAVASSALAFQVFVLYPWHNQLDAEFKSLKEEHIRVLNRMSQRTISQ

SEQ ID NO: 43611 - protein, 178 aa, A.fumigatus
RTCIFHRVVKTTEQCFRFSVHQVKSAQEMRQIIGESQTSLNPEHGPVFTVDLFHHGGEQSLLMIGHHLVLDLVSWRIILADMEAMILDPQHQPHLTMSFQTWAHLQAEYGTRHLEPPPGQQPCSIDEPSMRQFWGAENNANTGGDSKTRLIRMNDDLTRKLFGPSSQALDVEPVELLH

SEQ ID NO: 43612 - protein, 77 aa, A.fumigatus
ITGDAFTGVAFLRNAISIGIPFAISPWLERSGAQNMFLTYRFVSLAVTLTIIPMVLYGRKMRMLTAARYRVMAGLRD

SEQ ID NO: 43613 - protein, 279 aa, A.fumigatus
  UNSURE (163),(199): Identity of amino acid sequences at the above locations are unknown.
IALFLDVDAGGSLCLRNKAYSVAEHICSSHPHYFHHCSPCDSHLIQTSTAVSTTSRMSNHRSSDALTFPDSSRAFLEPHLPPNSKNFQSPDSGLPFTTLTFATSLDSALALSPGAKTVLSGPQSKAMTHYLRSRHDAILIGVGTAVADDPGLNCRIAGVGGYXGQGLQGQPRPIVIDPSARWDFTENSRILTLAREGRXRAPFILTGTQSIPAGEESSAGETRRQVHLSRRGEPLKQRTVPGTGTTLLKALTKERMEKGHEWRKGRPYLTFFFEAFLTR

SEQ ID NO: 43614 - protein, 179 aa, A.fumigatus
HLDDVHQNLEDDRQDEVKDWFKVQMEKAKRFQPLAVLNQKLKGLDVFESNENHHPSVGASRPAGAQTGNNEPPRVLDPEDIITKDHWQVRGLYDTCLEPSCGKRLNATNGCVNCRKCGKLFCEEHTMYQMKLSRSAQHEPVRGLWYRVCETCYKSREGYNDHNGRCLVFHHRGWKETRC

SEQ ID NO: 43615 - protein, 160 aa, A.fumigatus
  UNSURE (153): Identity of amino acid sequences at the above locations are unknown.
SSWWRSIVRPLRIAIILDNAANIRHALQVLALSGAPRTAFHQGEGPFPPEKMSEYLRDHPYGDCTLLYFGTCYGASEVRKWKLETIHREFMKVPVARRIDPATLAPSDYFWSRNRTSSGEPDLEELAWVNWWLNGGHIAFSPVPPIRGFYPAXRRQVRCP

SEQ ID NO: 43616 - protein, 149 aa, A.fumigatus
  UNSURE (143): Identity of amino acid sequences at the above locations are unknown.
SWLVSHPCSMAIEAYIDLICFGYRNTNGTLNFQSRIHKLAISFKLAPGASAENPSKPNLQLKYLDTILLTGPDGEPTTGLDAYATDSVSYRGFPPLPAATYTGDGFGGARNGGKRITIDAEGLVLDKDGFFWVSDEYGPYVYXSNKHGK

SEQ ID NO: 43617 - protein, 80 aa, A.fumigatus
  UNSURE (51): Identity of amino acid sequences at the above locations are unknown.
INDGLTPDPQNDINSKYGQLPKVKSQKRYLHGFAQTRDVIQAQPYPVGEDXTTPNFGRLSSENKLFIPWLHNHQSDVFKI

SEQ ID NO: 43618 - protein, 65 aa, A.fumigatus
MNEQTAGRETRVEMCLMSVSADTDAGIDDAICRLRVAYEILSLINQNMDHGLMLELYSFTVARPM

SEQ ID NO: 43619 - protein, 287 aa, A.fumigatus
  UNSURE (284): Identity of amino acid sequences at the above locations are unknown.
HFHIRGRQHFNGPPLGQILESIWWAGPGKLESWNASKIRQKAYIGLGETTGALEEGAKDQGINGTSSDTWENRIPVSRVTTDAEGNTYPEGGLEAWLGVIGSFMGLLASLGVVNTIGTFQAYLQDHQLKEYSPGNVGWIFGVYSFLTFFCGVQIGPVFDAKGPRFLVLAGSILVMVMMIALGFCTKYWHFMLVIGIAGGTGTSLIFTPAISAVGHFFNEKRGVATGLAATGGSVGGIVFPLVLETLFPKIGWTWATRVIALICLILLIGSCLLVKSRSSPTGPXISK

SEQ ID NO: 43620 - protein, 192 aa, A.fumigatus
GWLLAFVLFLTGGRANYQTASDALQAHGADSALGSTSTSSGKPVTLQQVLGGQWNPRYHAIGWVAGPNNEDGLLVEKGGDEKQGYLRVDDIRSRKGNNTGRESRVLMRKPIVHVDGQAIVPSNVWPSPDLKKVLLISEQQKNWRHSFTGKYWVLDVDSQTAQPLDPSAPDGRVHLHAGLEGNALAKFLPEGE

SEQ ID NO: 43621 - protein, 86 aa, A.fumigatus
EVLLLENPTMHVQPPSETAAVDTTLLKDETITTTVVVPDTPPPPTPLPLYFAYGSNLSFTRMRIRCGDNPDLSSKPVAISRLDHWR

SEQ ID NO: 43622 - protein, 69 aa, A.fumigatus
KGIDSRNAYARVLINTYHILSLKQVYTLSKVHHKWGSIATTPRRPYCSAISSAPSISTFEGSRQGGSTA

SEQ ID NO: 43623 - protein, 84 aa, A.fumigatus
  UNSURE (6): Identity of amino acid sequences at the above locations are unknown.
VNMTLXRLKACQGITVSDLSPLDCGRYPSQHVTNRQRRSSLESQNAFLISNPASDTDLDLGNLFFKSFSPAGWLGNYTSYLFCH

SEQ ID NO: 43624 - protein, 199 aa, A.fumigatus
  UNSURE (21),(191),(192),(193),(194),(195),(196),(197),(198),(199): Identity of amino acid sequences at the above locations are unknown.
ESNLVSQADTPTQNLGRPAIXRKRRPGRPPKNRPPDWDLADGSAPPPAHSGTPAKRRRGRPAASGGRWARNRGPSHVTQVPIDKEGNMMDVIDDEVALPPDPEGETKVDKNGVLKDGREYRVRTFTILNRGDRLYMLSTEPARCIGFRDSYLFFQKHKLLYKIIIDDEAKRDLIDREIIPHSYKGRAIVFXXXXXXXXX

SEQ ID NO: 43625 - protein, 257 aa, A.fumigatus
  UNSURE (231): Identity of amino acid sequences at the above locations are unknown.
VKTVCRMHSIALQLENGMRIVGLSVPLANARDIGEWIGANKHTIYNFSPHARPVPLELHIQSFSIPHFPSLMLAMAKPAYHSILQLAPDKPALVFVPNRKQTRSTAIDLLAACAADDNEDRFLHADVNELAPLLNRIQERTLAESLSHGIGYYHEALSATDKRIVSHLFTIGAIQVLLASRDVCWDLNLTAHLVIIMGTQFFEGREARYIDYPISEVLQMFGKATRPKDDXNGRGVLMVPSVKRELLPKRSSLTKLW

SEQ ID NO: 43626 - protein, 63 aa, A.fumigatus
VMVGIAEAILDYQSYSGLRAETMVMGKAQNSLPNEKPHKFVALIILFLLVVEKINKTLKCCAL

SEQ ID NO: 43627 - protein, 206 aa, A.fumigatus
  UNSURE (36),(43): Identity of amino acid sequences at the above locations are unknown.
TATLKGQDVVVNTVGTIPRDIHLRLIDAAIAAQVRXFIPSEFXSDTTNPTAAKLPVYQDKVAIQKYLQQKAAESAGSFSYTLMINGPFLDWGLTVGFLLNWRGPEVELYDEGERKFSATTLAGIAKGVVGIINNLEATTNRTVYIREIEVSQSELLKLSGKQLPTKSISTEELEKEGYAELAKPNPNPRAVALNFRLHTRREGTTS

SEQ ID NO: 43628 - protein, 198 aa, A.fumigatus
  UNSURE (73): Identity of amino acid sequences at the above locations are unknown.
NDNQKLWINMVPKEVSDSIDDREKKRQEIIFEIMYTERDFVKDLEYLRDFWMRPLRAAGNANQSPIPEHRREXFIRTVFGNCLEVLKVNGALCEALNSRQKESPVVKTVGDIFLQHVPNFDPFIKYGANQLYGKYEFEKEKASNPAFARFVEETERLKESRKLELNGYLTKPTTRLARYPLLLAQVVKIVQQPQKSNS

SEQ ID NO: 43629 - protein, 239 aa, A.fumigatus
  UNSURE (1),(2),(4),(5),(10): Identity of amino acid sequences at the above locations are unknown.
XXVXXRHPPXTPLKGPPHQPMLSGTPSPPGSASSVDVISSPPSPEDNPFSPAQSTATDITDDYGWQTPTKGQALSTATDKDCLESSQSEEEDDSAGDDGGDDEGDDEGDDEGDDEGDDGGDDDRAGHIASAFNAPSPTKPLERSKKAKSLRPRISISSLRSEDATKSVLIKRKESSTSPVDTCAWVLEQGKFSEGLTWPSILIGQKIRKRSRHIRLEYWTSEQASNIHSGFFCLKGIGS

SEQ ID NO: 43630 - protein, 75 aa, A.fumigatus
CDMPCSIIVTPIVTLIVTLIVTLIVTLIVTPIVTRGVVLFFALGGLEAVLICCRRQCLALGWSLPAIVIRDIGGG

SEQ ID NO: 43631 - protein, 205 aa, A.fumigatus
ILAVPENNWNPKWEFPRSNKPSKGAPRFQEPIPFRQKNPEWMLLACSEVQYSSRIWRDRFRIFCPISMDGHVNPSENFPCSRTHAQVSTGDVELSFRLINTDLVASSERREEMLIRGLKLFAFFDRSNGFVGEGALKADAICPARSSSPPSSPSSSPSSSPSSSPSSSPPSSPAESSSSSLWEDSRQSLSVAVDNAWPLVGVCQP

SEQ ID NO: 43632 - protein, 261 aa, A.fumigatus
  UNSURE (36): Identity of amino acid sequences at the above locations are unknown.
PIPERWKFGIVLRILASLAIVHIPGPRRDVWYHAEXLFVVFFFYGLCTTILSYVVSFVSKSQLAAFAIAAGGQCVLFLIYFISYMSVLTYAPTQKVDEYLEITHFTIGLIAPSGNLLRAMFTSLNTFSILCRGREIASYPGEITLYGGPILYLICQSFFLFGLLLWIDGGPVLSMMRRKVKQDHVEEKNTVDGDVAAELARVEGSTDGLRVLHLTKKFKKSVAVDDVTFGVPKSQVFALLGPNGAGENVFTTRGSPGSALV

SEQ ID NO: 43633 - protein, 85 aa, A.fumigatus
NETVSSSLALFAIHNLIRRNLKACAEHAITVQPANIDAFVTYAKYTLHVLRDQLTSVDEIWFPVFAEHDPRFLAQKDAHDALYHR

SEQ ID NO: 43634 - protein, 74 aa, A.fumigatus
STDTRMSGSTMSPSISTQQDEEKAIQPPVVSDSPALESALPPEGGLRGWLCCAGGSLGLFATLGFLNALSPSFR

SEQ ID NO: 43635 - protein, 114 aa, A.fumigatus
KSSGRTCRTTSAFQPIAPRPSLDSATPTNPAASHAAISPPLGSRPSAAGAVPARPGLSPRPRSSTETDPQLGMSQSPGYTSGDSYAQRPPQAHPGARSTTPALPVPLPVFTTAA

SEQ ID NO: 43636 - protein, 98 aa, A.fumigatus
FWNGSSKPGLCLDADIFIAIAYTYSVGAVITDFTIGILPVFIIWSLRMNTRTKMAIAGILGIGCIASAAVIVRIPFVHNYKDPDFFYATYQVRRSLRG

SEQ ID NO: 43637 - protein, 60 aa, A.fumigatus
GFPTLFHLGSSLHSPSETYSSAQLLLGVKDKESSAYLVYFCSFISTNSTRSISPSAFQQH

SEQ ID NO: 43638 - protein, 67 aa, A.fumigatus
IMFRILSREFNDFLYLSYMCSQGEEAGDGIYITWGFLFIKSRQKSYLARIDPYQLWMSSTRVEINIS

SEQ ID NO: 43639 - protein, 154 aa, A.fumigatus
CLDLDDQGHWDYHGHTSGIIFLRRLRKQLGASDMPVPSLRTRVLSQMLESPKSTSESPSDSTLPPTHDLPSRDVAQRLCHHALYDGCSLMRFVHEPSFFAMLDRIYDTPPEQFGNEENSFLPLLYIVMSVGCLFSDERAGTLDTAGYECAIGQW

SEQ ID NO: 43640 - protein, 159 aa, A.fumigatus
  UNSURE (1): Identity of amino acid sequences at the above locations are unknown.
XADLEEEYGMVLYIADTNVSSPWTQTCITQADCILLVGLAESSPSIGEYERFLLGMKTTARKELVLLHAERYCPPGLTRRWLKNRVWINGGHHHIQMAFRLTAEPTHPETKRFGTVLKQRVQVLQAEIQKYTSRRIRQTPLYSAQSPFKGDFHRLARRL

SEQ ID NO: 43641 - protein, 217 aa, A.fumigatus
  UNSURE (160): Identity of amino acid sequences at the above locations are unknown.
RPTLFRPLQIRNVTLKNRIMVSPMCMYSCESDPSSPHVGALTNYHLAHLGHLALKGAGLVFIEATAVQPNGRISPNDSGLWQDGTTSEQFLGLKRVVEFMHAQGAKVGIQLAHAGRKASAVAPWLAAQAGKSSLKADESVGGWPADVVGPSGGEEHIFSXEEDAYWVPRALSTAEVREVVAAFAKSARLAVQAGVDVIEIHGAHGYLINEFLSPVTK

SEQ ID NO: 43642 - protein, 79 aa, A.fumigatus
  UNSURE (17),(20),(22),(26),(40),(44),(53),(54),(56),(76): Identity of amino acid sequences at the above locations are unknown.
ARSRNSGRMSTVGALKXGTXIXRKVXAAIRAVNPEGNALXLRFXRTELVGGSXXWXPNRATGIFKPPWNLVKKLPXMGH

SEQ ID NO: 43643 - protein, 149 aa, A.fumigatus
  UNSURE (3): Identity of amino acid sequences at the above locations are unknown.
VFXDACPSSPAVKTYALPALTNPQCDAQEPHHGVAHVHVLLRVGPVVSPRRRPNKLPPGASGPPRPQRRRPRLHRSHRRAAQRAHLPQRLGPLAGRHHLGTIPGAEAGRRVHARAGRQGRDPACACGPESECRCAVAGGAGGQVESEGG

SEQ ID NO: 43644 - protein, 147 aa, A.fumigatus
  UNSURE (29): Identity of amino acid sequences at the above locations are unknown.
PRAFRKRRHHLTDFGRAQRPRHPIRIFFXTKDMLFPARRTHHIRGPPANAFIRLQTRLARLRRQPRRNGTRFPARMRKLDPDLGALRVHELDDPLQPQELFRGGAVLPEARVVGGDAPVGLHGGGFDEDEACAFEGEVAQMRQVVVC

SEQ ID NO: 43645 - protein, 161 aa, A.fumigatus
  UNSURE (46): Identity of amino acid sequences at the above locations are unknown.
PCAPWISITSTPACTASRALFANAATTSRTSAVLSARGTQYASSSXLKICSSPPDGPTTSAGHPPTLSSAFRLDLPACAASHGATALAFRPACASWIPTLAPCACMNSTTRFSPRNCSEVVPSCQRPESLGEMRPLGCTAVASMKTRPAPLRARWPRCARW

SEQ ID NO: 43646 - protein, 261 aa, A.fumigatus
  UNSURE (31),(33),(35),(53),(257): Identity of amino acid sequences at the above locations are unknown.
REGVFVGPICLLPDRTKAQRRLDRRPFANPXGXSXFPLQHVLKTSLQSAHVRXGSFTSLSSSVHSLSHPPLPVDHREAIMAAEKKSLEQQPSSPGLMGPPLAPASAYRSNSTQRPLTPNESGTQVYSSKTSISRAQIRRESQVSRRSSVSSFASELEERFNIQAYSNHMSNGYAAGTDPRMIQAITQTMIGEFLWKYTRRTVTGETSKTRHRRYFWVHPYTRTLYWSEQDPQTAGKNQLRTKSVPIDLNRGIEAGVXKSSQ

SEQ ID NO: 43647 - protein, 183 aa, A.fumigatus
  UNSURE (1),(2),(10),(34),(48),(57),(65),(67),(69),(78): Identity of amino acid sequences at the above locations are unknown.
XXTPKGKNPXLAHPAPPKGAIGTKNLLGPPKPGXKTPLPPPGPGGIWXGKPKFSKIXPKNPPFSXGXWXTPSTRKPIXYKIFNNNCPRLLAKPGSTVYKRAGFARHALWVLPYRDHEIFPAGQYVCQSTGEENHPHNPTIVDWAARNESIENTDIVCYIQFGLTHFPRTEDLHHGAGRTRVRV

SEQ ID NO: 43648 - protein, 111 aa, A.fumigatus
  UNSURE (40),(46): Identity of amino acid sequences at the above locations are unknown.
SVYSQSIIPLLLMLISPRFPPVLHEWFVEMFPETGAWFAXRLRYTXSCAVMSMVGYVLGYAVLDCRLRIVNYVLTSESRRLGDRHGENILFEEGTGGVIHVDFNCLFDKVR

SEQ ID NO: 43649 - protein, 63 aa, A.fumigatus
DGMGPNSGFWNVKPCFNQSRAFGQRKVSPYLIKKAIEINMYNTTCAFLKQDIFAMPVSQSARL

SEQ ID NO: 43650 - protein, 94 aa, A.fumigatus
  UNSURE (86): Identity of amino acid sequences at the above locations are unknown.
LVQVRNCSWIQGFSRSSLSSAVLETNNVTWAGCTSWAAMHDSPPLLKAHTSQFHASLFTFEPTQVGILLGLPNYFPGVGVEGKRLXPRESKDPR

SEQ ID NO: 43651 - protein, 172 aa, A.fumigatus
  UNSURE (6): Identity of amino acid sequences at the above locations are unknown.
QGRHGXQEDIKPFLTLALDICEQTPGPESAQLLADIHYGLAAAANETNDGAACLSHTEQLLKLRLETSSSTGKNDIRLAIAHNEYGIALVMNNEYEKSIAAFKTSIDVYRGLLDYWPSMDTNPRTNMSFTFWVMGDLDQAWQTLRDLLSDRETKFGVNDRESYKYVDSHQRL

SEQ ID NO: 43652 - protein, 124 aa, A.fumigatus
GVSSTGGYRQTHLFYSKIGFGKPNLGKVPIFDGGRKTKGGGKGDKQEIWQFLWMANYPRRALILVRVLSGAKSWISFKMGHGSKQMMAKPGGTLYQFCAHDKFHEFRVPTNADVSQHTCTTPCH

SEQ ID NO: 43653 - protein, 65 aa, A.fumigatus
CAVPLPSNTTPKIKNEGRKRPYNDPKSIQVTFHICNNVALQGEAFVSSDSMLSSYTDGDGTYASN

SEQ ID NO: 43654 - protein, 177 aa, A.fumigatus
  UNSURE (3),(4): Identity of amino acid sequences at the above locations are unknown.
VFXXWRGSFQPRVKTNSRRRGSSPDTSRTDKNEPTADSAKARKSRDDRRLSRSRDRDDERRRRRSTRSVSRSRSRSRGRSRTGSVSPRRASRSRSRSYGRERKRRRSIERYAPAARRRRNTSSVSTHTEKRQRMAESSQEIPKRSSSPAEQASFTDYDPKGSGEGGNWFQMDFLPDE

SEQ ID NO: 43655 - protein, 93 aa, A.fumigatus
CISSTLKRVSTVDAISASIPGEVKLAVAHFKRELIKLPFLWCRSMGSVVRESEFECGGHFAAWEVPELLAADVRSFLGKGGQAYAAVTGKNGY

SEQ ID NO: 43656 - protein, 61 aa, A.fumigatus
  UNSURE (5),(15): Identity of amino acid sequences at the above locations are unknown.
SAYLXSAVPSSPVVXSDYPWTDDEILTWVSVYQFSVAGPAASVRIYYEAAQTPPADASARR

SEQ ID NO: 43657 - protein, 251 aa, A.fumigatus
GQGSRISDHSGRWYHGHRPGEGKNLIKWTDREYRLHRNTSYNALAKNGGMRIIRQEDGSDKQFFRATRDRVFNVTVCTSATTSGVSEEQAILGIGVSGTVYWALISRGEKDLFELDALESESLIFPPFPASDENTSGGQLKTRAKRSSRHPGFFAIGRGKNIYVVCPQAAANANYGVSGSQRTVNTEKFFKERALKISTGKAGKDFVFSDDDTVVASLDKTGRLRFWDIREVVNNPDFVTNVPSLQTGLKI

SEQ ID NO: 43658 - protein, 87 aa, A.fumigatus
  UNSURE (81): Identity of amino acid sequences at the above locations are unknown.
FKMNSIRTTSFRSLVPLFRRLDTPRAHSTSSVSTNELSHFSALASSWWDPVGRSRIRHLMNPLRHEFISSCLAESLTPPRXNPSNPP

SEQ ID NO: 43659 - protein, 70 aa, A.fumigatus
IIWAPLDYLCSFPGKDIRGKLISAFNQWLQIPEDKLDVIKRVVGLLHSASLLYALPYMFASGIGSLQSQN

SEQ ID NO: 43660 - protein, 80 aa, A.fumigatus
EVYNHRIDDIQDSSKLRRGFPVAHSIFGIAQTINSANFAYFWAQQELKILGKPEAMVIFTEEMLKLHPRPGAWISTGENP

SEQ ID NO: 43661 - protein, 255 aa, A.fumigatus
  UNSURE (84),(204): Identity of amino acid sequences at the above locations are unknown.
YDLPGCSGAIRPVPNWMCASSKFPSMIVFRFFSGFFGSPTVTNSGGSITDIWPQDNRSVPLALFSAASFLGPVIAPTVGGFICXYTSWRWNFWVVLILSGVCYGAMMVFLPETYSHKLLMDKKRCMPGYSPANQPPVKEMLYTTLTRPWLMLFTEPILFLLSLYMALVYGVLYLDFTAYPVVYRETPSWSAIIAGLSFLGICVXMAIATLISPYANPIHGIYLPSLGKSSTPRVASPHLNVISLANPRLTWFWVW

SEQ ID NO: 43662 - protein, 64 aa, A.fumigatus
TPAPPGLDKPPAQFTGIFIPPPFPQFNQSTPMARFFPYALSHNFNDTSLLPRVRFMPVVLPFPR

SEQ ID NO: 43663 - protein, 84 aa, A.fumigatus
SPSGWLVQFLVSVRHGDPKKVGYVASGFWSGFTLGRVLLADITHKLGERRMVFFYIALSIALQVMFWLIPNIIANAVTVCLMGG

SEQ ID NO: 43664 - protein, 62 aa, A.fumigatus
PAQAKVLASADSPSSMRQACFPSPNLPFMVVYYNPESLLFISIEVINACSAALPAYDYFCLQ

SEQ ID NO: 43665 - protein, 60 aa, A.fumigatus
  UNSURE (3),(26): Identity of amino acid sequences at the above locations are unknown.
LGXRTIATSHSVPRARSLSSPTWSSXDVLVDAVSITAFTGILRSMNGRSMIIRHVCLSWR

SEQ ID NO: 43666 - protein, 272 aa, A.fumigatus
  UNSURE (6),(67),(73): Identity of amino acid sequences at the above locations are unknown.
SPGQAXSTPRQKFIGASIALRAVKLLYGAWQDAHSPITYTDIEYFVITDAARYVSRGASPNARDMYXYTPLLXWLLLPTTWDSIPGFLAFGKAQFALADVVAGWLIAKVLVSAYGMSPSRAQKYASVWLLNPMVANISTRGSSEGLLGVLVVGMLWAVLSRRVSLAGAILGLGVHFKIYPFIYGPAVVWWFDAERDGSGSPRGTATARAAREKDDGQDGQGILSKAVDFLTPARIHLTLVALATFSALNVSMYILYDLPFAQNTYLQSSRPG

SEQ ID NO: 43667 - protein, 112 aa, A.fumigatus
  UNSURE (96),(101),(103): Identity of amino acid sequences at the above locations are unknown.
PAHFLLCSNPGQSNDKKRLPKPGPYRFPNTAVTMAGGAAKYRHLSRKSSHRQALLRNLVTSLFKHESITTTCAKAKEAQRLAEKLITLCKKNTDAXLIRAXSXFYVCAPTDS

SEQ ID NO: 43668 - protein, 64 aa, A.fumigatus
  UNSURE (64): Identity of amino acid sequences at the above locations are unknown.
TPLILRRLIQHCGRFYNQTSFSGLETHIANSFTNALLQLLKFILLVRNLSSHTATAGYKLTLRX

SEQ ID NO: 43669 - protein, 213 aa, A.fumigatus
  UNSURE (107): Identity of amino acid sequences at the above locations are unknown.
GILKGINLGSSQSILSWWGMDISPSRRSSGLLRMRSVPSHLWGSRFKIHFNEMSKEFELADVVLRPLPLECSPDTPLNMIGMPYYRERLLSASLSHLVFEVGSPPAXIDQSLIPYLRPAEMGHYAPNPKKTRRYQVENTRALTTAEPALIAPKFLSEKAREQSKFKSEASVSDTAEALAGAKLNGEAEDDPLLKYSNVEIKYSRFGVDDFDFR

SEQ ID NO: 43670 - protein, 76 aa, A.fumigatus
KKRTVSINMATKTPVLTEKAPKPLPGIYSQAIIANGVVYCSGAVAMDPETGKLIDGDVKAHTVLPSIYTFVVSLVE

SEQ ID NO: 43671 - protein, 65 aa, A.fumigatus
  UNSURE (63): Identity of amino acid sequences at the above locations are unknown.
LKKMKESLTHVCSLATSRSCDATFINQPKSTNAIVAICPYALKLSVSRNLVFTTGLRRDRTTXDA

SEQ ID NO: 43672 - protein, 186 aa, A.fumigatus
  UNSURE (58): Identity of amino acid sequences at the above locations are unknown.
ARILPAPRGEDARALGGLLNGNIGVLQTTVAEIVTVKEHQPRAYSIMPFVWCLGSIIXPAMGGALAQPCQNYPGLFQRHTIFDSFPFLLPNLVCVVVLVFGVIVGFLFLEETHPEKRYRRDPGLELGNWLIARCSGSRVQLTEDDTDIQVDANETDYFNYGDVPPPEYRSTETSPQLAAIKNVGAL

SEQ ID NO: 43673 - protein, 197 aa, A.fumigatus
RGIFEPRGEEVPSVPLTTDLSTPVSPVVSLFSAKGHTRVSSSVSSLVSSTGQGNSMESSRNALTGLKEEPRQARDLEEEYFRTSFPPTKPFALPLHTNYFSAEHFDQGMSVVNDTYFRPSADYPESYDLNDAGMDNPHSTKKRRADSLSGNGLSRISSRISTISTRWRSNRVSGGPDAVDAIGSSLRSRTNSVSSVR

SEQ ID NO: 43674 - protein, 76 aa, A.fumigatus
  UNSURE (32),(35),(36): Identity of amino acid sequences at the above locations are unknown.
TKWNWKMILPKVAEPTNFLVYFQGNGALPFHXIFXXFSPYFFFPTVLERLSVPSQSLHSGAQSIYLFALFRELGPA

SEQ ID NO: 43675 - protein, 151 aa, A.fumigatus
TPRRRYVPFFSNSPYLTCSLGGQSVQDGSPSGHFLSRGRQASRYGKGEDVNAVFLKRLDHALRDGDPIRAIIRGWASNNDGTRSPPMCPGPDSQAACIRSAYAMANLQDFETTAYIQCHGMESTVRIPFDPAVVFYHFHQLNVYQVGQPLD

SEQ ID NO: 43676 - protein, 100 aa, A.fumigatus
  UNSURE (3): Identity of amino acid sequences at the above locations are unknown.
QHXNGPQGKTIEGKLSSVPKFSCGQDKKGFSISKLHLSTSKETEVHIVYGMPDGSTCRNIASCSPDGTQVTNDQCGGATSVSFEPPEGSEVLTRRWKDNA

SEQ ID NO: 43677 - protein, 146 aa, A.fumigatus
  UNSURE (69): Identity of amino acid sequences at the above locations are unknown.
YSNPENTDNECTDHQKGGWDWSDLSSGSFSSYGGFDFSGFKCSDSTGWGKRTFVSRLNLLLPHHNSNMXMAHRAKPLRGSSHLSPSSPAAKTKRGSPLASCTSPPPRRPRCTSSMACPMVPPAVTLLLARPTVPRSPMTSVVVPPP

SEQ ID NO: 43678 - protein, 81 aa, A.fumigatus
TMRGSEASGPGAIFGAPSTLTTSVIRNPTSFLSSSTPLPSTDADVIAQNVEHVLLSLTSHNDGGLVGVQWQLSLTTGGDPR

SEQ ID NO: 43679 - protein, 94 aa, A.fumigatus
LPESAIMASNSYKALRSQYQAALKRFINSSKNLDILNSVPLNHQQYQKQASQAPYILYVLDSSCNPPTLAHLRIAISTLSGKTQCSLPAAATPP

SEQ ID NO: 43680 - protein, 134 aa, A.fumigatus
  UNSURE (17): Identity of amino acid sequences at the above locations are unknown.
FMSMVDIFDYLPRSHPXYEKNLRRFQSLAKAFKKTQDKSGGWWLIMDGEYPRDPRKYIESSGTAMFAYGLLKGVRKGYIRSKDYLAPATKAYNLMVDKFVETNADGTLNWLGTVQVGSLSSNGTFEVSMNLYLT

SEQ ID NO: 43681 - protein, 212 aa, A.fumigatus
  UNSURE (138),(160): Identity of amino acid sequences at the above locations are unknown.
HLLGGGAWLGGQLFSAMVLRRPAEVFLNEIGVPFEEDPANPNFVVVKHASLFTSTLMSKVLSFPNVKLFNATAVEDLVTRPSASGDAKDTQIAGVVVNWTLVTLHHDDHSCMDPNTINAPVVISTTGHDGPFGAFCAXRLVSMNTVDKLGGMRGLDMNSXEDAIVKNTREVAKGLIIGGMELSEIDGLNVWGPTLAPWGLTVVKLPKSPLRS

SEQ ID NO: 43682 - protein, 173 aa, A.fumigatus
  UNSURE (1),(2),(3),(4),(5),(6),(7),(8),(9),(10),(11),(12): Identity of amino acid sequences at the above locations are unknown.
XXXXXXXXXXXXKTFAPIRESQVSRAMTRRYFQDLDKYAESDIVIVGAGSCGLSTAYVLAKARPDLKIAIIEASVSPGQFSLHKPSASKLTSPRWWCLARRPAFLCHGPPSPCRGFPQRDRRALRRGPCKPQLRRRQARLPLHLYLDVQGPLLPQRQALQRHCRRGPGHPSLR

SEQ ID NO: 43683 - protein, 98 aa, A.fumigatus
  UNSURE (2),(6),(8),(9),(10),(20),(27): Identity of amino acid sequences at the above locations are unknown.
GXKFQXRXXXKNRAIVEEIXKLAAREXCTTSQIALAWFPAQGFIAIPGTTKAKRLEENWASREIELTEEEKQEMRRIIDVAKPHGNRYGPENQALVGH

SEQ ID NO: 43684 - protein, 69 aa, A.fumigatus
LVSAAYLALFFFNGYNYYVLPAEYSDRDSVLLWNFRAGLFLAFIYPGATAARQMVSNKPRSTGDHPKRN

SEQ ID NO: 43685 - protein, 109 aa, A.fumigatus
HTIGRSMDSILVVSSPQEASAPSLAPSCVLCLPLFERFPIPLPPSPKRRGVDFAHTKLPHPLTYRATHQSYGPCFTLSLTSYTFNSRFLDADFRRSLEETADKGFAYPL

SEQ ID NO: 43686 - protein, 123 aa, A.fumigatus
QCTGDLVGLGTNGMDVLCRWDKSMRPAIDSIRAAISSFDYYDSNGELRDCLPYAPGDLLNVEVVQMSGLIDLLYGKAKDCGIDLRFGAIVCDYWESEGNAGIVLENGHKVAADCVIAADGWGT

SEQ ID NO: 43687 - protein, 112 aa, A.fumigatus
  UNSURE (108): Identity of amino acid sequences at the above locations are unknown.
LLLMDGVHSKATGTITGKDVAPYSTGAAIYRSHFDAREIRDDPEANWILDSTGRADHANMYLGKDTILLVGTVGKGKNVSWDMPHKVSSSLAFPFLEGSYTTARWKVXHLAY

SEQ ID NO: 43688 - protein, 167 aa, A.fumigatus
YVLFFPSLFGGPSFEYVDYRRWLDTTLFEVPPGTDPSKVPPTRKKRKIPRSGTPATKKALMGLVWIFVFLQLGSLYNKESVLGESFLSYSFLRRVWILYMLGFTTRTKYYGVWSLTEGACILSGLGYNGFDPKTGKVFWNRLENIDPWSLETAQKSSPRVANPRISH

SEQ ID NO: 43689 - protein, 158 aa, A.fumigatus
RRRIFQPRGEESSPSPDQSPPPRPTKPSPPTTATTQQPGQLPSLLLSPRPPYQQNHPPPPPPLRPHPQPTTAPPVSSLQHPPTKLQATSPKPASPTPLSRRTRPLKKKSTGRAPSTGSPPRHSPRKYPISSSRKSTPNKSRSSPMASCTSPRSSTGGS

SEQ ID NO: 43690 - protein, 108 aa, A.fumigatus
  UNSURE (6),(54),(60),(76): Identity of amino acid sequences at the above locations are unknown.
WVYRLXSVARGEQDYFTPDGIPTATEGCRSNALVRCCKDLGDCKRTVGNRGWNXAVPRRXNTPARCLFNNVVEQKXGTRIWVTQGRIRFLIRWKEIGNKLLEPMFPGG

SEQ ID NO: 43691 - protein, 128 aa, A.fumigatus
RILSLTRSITTTSSYKAITTNNSNNPATRTAPKPPIVSTPTLPAKPSTASTSTAPAPTTDDRAARILAPTPTHQTTSNISKTGLADAPLSPDSPPEEKIDWTRSFHGLSAAPFPKEVSDILLAEVDPE

SEQ ID NO: 43692 - protein, 107 aa, A.fumigatus
  UNSURE (75),(83): Identity of amino acid sequences at the above locations are unknown.
VEIKPDGILYLPEIKYRRILNRAFGPRGWGLVPRSESIVTPRTVNKEYALVCNGRYVFFASLLLWDGRVWGDTNXGLMGVQVXVCRAGRAGLLHAGWDPDSNGRVSV

SEQ ID NO: 43693 - protein, 163 aa, A.fumigatus
  UNSURE (2): Identity of amino acid sequences at the above locations are unknown.
PXICISPYSPVPKQKRSKKYIPPITNQSILLVHRTRRNNTLAPRHEAPTPWPKRPVQDPPVLDLGEVQDAIGLDLDLFGVDFREEDIGYFLGEWRGGEPVEGARPVDFFFRGRVRRERGVGEAGFGDVACSLVGGCWSEDTGGAVVGCGCGRSGGGGGGWFCW

SEQ ID NO: 43694 - protein, 174 aa, A.fumigatus
  UNSURE (171): Identity of amino acid sequences at the above locations are unknown.
PMAWQEIRRWRSMKERSQLVRKEAHDPMDVVYIVSRPYTAAAGIKAASRFSHSRRQILVRWAIAYATTPAALLVLCLGVAGLLSCLCQYLILQAVEKTVPELSTQVGAFADKVVDSVQNASAEWANDANGVIGHMNQDLNENVFGWVNTSTTALNDTVHTFVVLEQAAGKXTVR

SEQ ID NO: 43695 - protein, 264 aa, A.fumigatus
  UNSURE (230),(240),(250),(256),(261): Identity of amino acid sequences at the above locations are unknown.
IFGGGHISSSRRLMTAQWVWDCINEGRLVRPDLYAPGATLPPHLSPWVKPSRGGYDPKASLAEQEEEGEAELDEDSDEEMEEATSDKKAEGKADVGSESEDEDESVDGGMDVAGTDDDESESEDEEEDFDGFEEEAASESEDEEEAARTQHQKELEAETAGLPFSSNGATIDGSKKKASQAKKIAAKKRKEEEELERQKMMMSRKKRKLLEKMIYSNKKQSEEAAKLRSXRRKLENGGGXMSSYRIKVSXMLLGDXNDILXLGI

SEQ ID NO: 43696 - protein, 67 aa, A.fumigatus
FGSSLFFKSIKVFLFIFTLALIIIGTGNIHAAVNRLILIFTFRSNICLTFGLLIAGRFFHLLVTVLV

SEQ ID NO: 43697 - protein, 159 aa, A.fumigatus
IIFSSNLRFLRLIIIFCLSSSSSSLRFLAAIFLAWEAFFLDPSIVAPLEENGRPAVSASSSFWCWVRAASSSSSDSEAASSSNPSKSSSSSSLSLSSSSVPATSMPPSTDSSSSSLSDPTSALPSAFLSLVASSISSSLSSSNSASPSSSCSARLALGS

SEQ ID NO: 43698 - protein, 96 aa, A.fumigatus
  UNSURE (31): Identity of amino acid sequences at the above locations are unknown.
WLFWDTERLARLPLRSPINWASTKGYCVRLXSWVPFPPQSLSLSPCPRDIVYAFTVPFPLVTLAPQGVVASLDSPTNGSTQRSGLVTGTGADSDGG

SEQ ID NO: 43699 - protein, 229 aa, A.fumigatus
  UNSURE (96),(201): Identity of amino acid sequences at the above locations are unknown.
QILASPARSTAHDEPRATTTVIVPATKIYYPPSESAPVPVTSPDRWVLPLVGLSKDATTPWGANVTSGNGTVNAYTISLGQGDSDNDCGGNGTQLXSRTQYPLVDAQLIGDLNGNRANLSVSQNSHHILNLGNDSHLTVTTSSDDEDFPISTVPFGLNLGHKGEWNGSLALGGLYDANRLTDDATSWISIAETMNNNGTFXQTGKQTLSRRRLPPRRLEGTALGVKRAR

SEQ ID NO: 43700 - protein, 130 aa, A.fumigatus
  UNSURE (47),(101),(110): Identity of amino acid sequences at the above locations are unknown.
YRIHSILLYRVPSTKYPCDDVTETISPAHVARSPRGIYVGLLLAVLXPTVQLLVVNHLMIDHYPDFVDVCATWLVEHELSISSAIAVQMQDSIGSSLSVNXSAKLARMMXQHKRSYSKDMNSGLWALKTL

SEQ ID NO: 43701 - protein, 64 aa, A.fumigatus
  UNSURE (43): Identity of amino acid sequences at the above locations are unknown.
LVWSMARSSGGELLTPEINAVPQAFSKALSAEWQIEGHCCQIXSLTIDSHSRHLHLSGTVAFLV

SEQ ID NO: 43702 - protein, 71 aa, A.fumigatus
RLPPKRPYRRTRSFSGSESPDELAVDADVYWRSRNRGRSPSHSETSAQEQLSERYQDDEHEAHDEESTQDV

SEQ ID NO: 43703 - protein, 178 aa, A.fumigatus
RMYTYAVTVPISSLFERELDIEDLESTADAFELKVDIAEGASDGQGIDSALADRISQAVATIRRNIVIPLIYHVESSLTPVGSPVQHNGPLRRSDDAYLSLIKHGLRLAPEYLTVDLSYSDDILSQVIASKGTSKVIGHFAWSHPCPKGWEDAEPLAMYERARRLGHQPPDGRSASRE

SEQ ID NO: 43704 - protein, 84 aa, A.fumigatus
  UNSURE (80): Identity of amino acid sequences at the above locations are unknown.
RVNTTSYSAPLFCMRNAISLIEAPINHSTELRARRTDVFFFCILAYIDILTNGIRGMLTVLDNPQYVNVTVFYHKGPKDXRYAY

SEQ ID NO: 43705 - protein, 68 aa, A.fumigatus
STDNMSSTDEKHGISVEHGSPGSDTDNKPAGLVGQGEAAKVGGAKTRKVFNVSYLRSRPSTRILNDMC

SEQ ID NO: 43706 - protein, 62 aa, A.fumigatus
HDNPWSFVSFCLIPRLPATKLLILYKSAHFQLSYSYQRTLCLWKGVLCEVDIYYISQHPQVL

SEQ ID NO: 43707 - protein, 130 aa, A.fumigatus
DDRGVRAGYIFTACIPTTIASNVVMTRSAGGDDAAALVEVVIANFLGPFITAGWTVTLLPTTAEFDPWRQANGDLSEMYKDVFKQLGLSALLPLVIGQLVRWAWPEQTERVMQTYRIAKLGSACLLLIVW

SEQ ID NO: 43708 - protein, 113 aa, A.fumigatus
FPSYYNQVVAIVQSTLIFVAVSEGFGTSIDLLVQEQINRIQTVRQPASYTARDSTLTSIQLVTISDILYLITIYVSKCCVVGIYLRLTPQKTHNRISWATLILCTLWIIPSAL

SEQ ID NO: 43709 - protein, 172 aa, A.fumigatus
GLRARIFYARRCNTNPFLETKEDSTLNPLSPNFKAKNWMKNLLALSSRDPERYPKRVAGVAFKNLSVHGYGSPTDYQKDVFNSVLEVGTLVRRIMGTGKQKIQILRDFDGLVKSGEMLVVLGRPGSGCSTLLKTISGEMNGIYMDENSYLNYHGISSKYIVKQFRGGGYLHC

SEQ ID NO: 43710 - protein, 70 aa, A.fumigatus
RFKDNQNGEQQIAIREFLMLVYNFYLDEILILFLLHSGDGTRTFEIPSQKCTILCPCVALIIGFFFALVQ

SEQ ID NO: 43711 - protein, 62 aa, A.fumigatus
IAVVSFIHIYLIYYVVLQGFCPSFGDIIRHDVEMHEQTIQYTMRPSSQEFLLIWKYIPVIKA

SEQ ID NO: 43712 - protein, 155 aa, A.fumigatus
LTVSVTVMTLTGLTIKGRCVELEVSISSQRGWGTEEETEAAEEVETVAEAVVEVEAVVEAVEAVEVVEVVEVVEVVEVVEVVEVVEVVEVVEVVEVVEVVEVVEVVEVVEVVEVVEVVQVVEVVEVVEVVKIVEAVEAVQVVEAVVKAVVEAVIQ

SEQ ID NO: 43713 - protein, 137 aa, A.fumigatus
LLLLLLLLRLLLLVLLLLLLLFLLLLLLLLLLLLVLLLLLLLLLLLLLLLLLLLLLLLLLLLLLLLLLLLLLLLLLLLLLLLLLLLLLLLLLLLLLLLLLLLLLLLLSQLLLLLLFLLQFPTLAVRIYLPQVLRTFL

SEQ ID NO: 43714 - protein, 127 aa, A.fumigatus
LYNCFYYCFYYGFYYLYCFYCFYYFYYFYYFYYFYYLYYFYYFYYFYYFYYFYYFYYFYYFYYFYYFYYFYYFYYFYYFYYFYYFYYFYYFYCFYCFYYCFYFYYCFCYCLNFFCCFCFFFSSPPSL

SEQ ID NO: 43715 - protein, 179 aa, A.fumigatus
CITASTTAFTTASTTCTASTASTIFTTSTTSTTSTTCTTSTTSTTSTTSTTSTTSTTSTTSTTSTTSTTSTTSTTSTTSTTSTTSTTSTTSTASTASTTASTSTTASATVSTSSAASVSSSVPHPRCEDILTSSSTHLPLIVSPVRVITVTETVSYTRTANPSSIRHSISTSDSTSEGN

SEQ ID NO: 43716 - protein, 194 aa, A.fumigatus
  UNSURE (5),(8),(56): Identity of amino acid sequences at the above locations are unknown.
NPTFXWVXPQPSGPSFSFRRSRSKEVREAMRNQGRSRMLLPAEFQPKTGSGKTIEXYTREINTLPHFGLSENLVLDVVEELEAEQRHKCLSEEWAGFSSNGTEPTPATTTDNDSTTSGNSSAVGSDADESTSGSRSRSKGSSNTASTSSTADFESLIESTSTSTTTFTSYLEVVPECIKVSVFTTGLEGPTLRV

SEQ ID NO: 43717 - protein, 216 aa, A.fumigatus
  UNSURE (10),(27): Identity of amino acid sequences at the above locations are unknown.
SGTGMFGPGXRSGPRTGAFVGGKRPGXPNSLKSNGPQYDLGSQSLYYIAPAPKSQGGGAQRSLQRAPGQSAASLIDADDEDPFIAAGMIGRGAESKEERFRRRLVQQQRERDITQKLVTSRAGNVGAEYLRSRANKPTTSSQPESAASSSQEKSSFEASTPVSATSLGLTGFRRADTVKLSPLKRAYDGDKQHNGSVKKTRFITSSSPRLQEPSRQ

SEQ ID NO: 43718 - protein, 160 aa, A.fumigatus
RGCGAPVVKTIDSLTALCRSSGPSGGTLNTVLTIFDSLSFSDILKSTDPFALAASAPPKNVPSEPLVDKILGVRSVRDLGTLTTSPSAMADITIVHRSSTLMPEFYGPLFYFRQFVKVRNALVGIIFHYAFIIGLCLLTLPPVRALVRQFVYAAGQGPRK

SEQ ID NO: 43719 - protein, 210 aa, A.fumigatus
  UNSURE (8): Identity of amino acid sequences at the above locations are unknown.
TFLRLGVXKRRERGRRLGLPDLPPASEKDESTLGEDEVDIPDEELNQKLRDLKEPICLFGENHVARLRRYRRLVRRSMTPQPKVTDGPIPTTLEPVSEVDMKIPTTLPKDADGRKFLFRQLASYFNMVLLEWERALARRDASVKQSLTGRQAYNAMVQSRENLKPLFRKFEKNDIDDNLLEPIMEIVHNAQLRRYVDAHDAYLRVSIGKA

SEQ ID NO: 43720 - protein, 174 aa, A.fumigatus
  UNSURE (94),(174): Identity of amino acid sequences at the above locations are unknown.
KSDTTKSDPVNEDPVPPEGLYVKKVSPVSEVSSQLAHWEHVKPSSLLSSKPHHDSSVYKELVDKFCFYGSTKGSNGTNDSLSNGKSHPDPPSTXSTSPAQSLSPPLSPRSTEVLGIDYGNSCSSSASPVSSSPRAASSSPPHFDYAHHSHVQSNFLKESSTPAVIRGCVWLFQX

SEQ ID NO: 43721 - protein, 74 aa, A.fumigatus
LTGKMSVGARDLSMNEFREKQEVKVMIASLMAGGTGIDMSMANKCILVDLWWNEAVQQQVRICLRTTENTRSNW

SEQ ID NO: 43722 - protein, 76 aa, A.fumigatus
LSQAFCRLYRIGQEKVVEVVKIIVHNTIDDYILQLQTKKSVNINKAIGEEALHKRDKIIDLLKMFAEVEVPDNGGI

SEQ ID NO: 43723 - protein, 62 aa, A.fumigatus
KSKYVAYVSPNYDGTAQESMVPKVGEFLAVDPGERALLRAYQYADNRDGDDETRKLCLRWDI

SEQ ID NO: 43724 - protein, 175 aa, A.fumigatus
LSVATLSIVSYHKDPKPVDFGRQLAASAWLLYMCAAALGGVNDAKVWGNRALVRRNTYGESACWYASLVARLTVPIAYNFLTFLPLSVRQNTIFYHFLGRLIDLTPLGQGYDYFFPVFILLPVFATLFNLYGRIKNVCGLGLIEEDDNELESNPSGYGLAGCLHATELAESALML

SEQ ID NO: 43725 - protein, 236 aa, A.fumigatus
  UNSURE (48): Identity of amino acid sequences at the above locations are unknown.
KRLFPTTCPLTSNDEFMFSFMEPLLHFTMGGIEINEHVQVFNSEKKPXNVLYACGELAGGVHGANRLGGSSLLGCVVYGRVAGDSASQYLFKKLTSGSTTAQQRLGQISLHIDPSTPGKISVEWNGAAASGAGSAQVTAAPEAVQTGGQGAPAPAAAASKPNDISNFKIPEKEYTMEEVAKHNKKDDLWIVVKGVVLDVTNWLDEHPGGANALFNFMGRDATEGMSSHPRTTRRPC

SEQ ID NO: 43726 - protein, 103 aa, A.fumigatus
IRSVPSVSESDSQSHTMADDKKTNEYTIEMDKLDHGNKDFEAPAPAVRPRGPPVAQLANNPILPVLAYCGSSILMTVMNKYVLSGRDFNLNFFLLCVQVSWSD

SEQ ID NO: 43727 - protein, 327 aa, A.fumigatus
  UNSURE (250): Identity of amino acid sequences at the above locations are unknown.
EWRAPSSPVVKTRMQEGTGLQEGTHMQEGTGLQEGTQMQEGTGLQEGTGLQEGTQMKEGAGLREGMQIKEGAGLREETWMWEGTRMQEGMRTQEGTELQEGSRMQEGTGLQEGAVLQERAELQEGTALQKEMQMQEGTQMQEGTQVQEGTQMQEGTGLHEEMHEGVQVQEGLELQDGTQMQEGAQMQEATGLQKEMQMQEGMQMHEEMQMQEGMQVQDGTGLHEGAALEGTGLQEEMQMQEGVHVQDWSXLEDGTQMQESFGLHEGKQIQEGTRVQEGTRVQEGAQGQERDPVAGRDTRPGGDRAGRRISNSPGGGGPRGVGAFMKG

SEQ ID NO: 43728 - protein, 240 aa, A.fumigatus
  UNSURE (181): Identity of amino acid sequences at the above locations are unknown.
RRGRGCGRRRGCGRARGCRRGCGRRRGRSCRRGRGCRRGLGCRRERCCRRERSCRRGRRCRRRCRCRRGRRCRRGRRCRRGRRCRRGRGCTRRCMRGCRYRRGWSCRTGHRCRRGRRCRRRRGCRRRCRCRRGCKCMRRCKCRRGCRCKMGRGCMRERRWRGRGYRRRCRCRRGCTYRTGXGLKMGHKCRKALGCTKGSKSKRGLGCRREPGCRKVRKARKGTRLQEGTHVQEGTGLAEE

SEQ ID NO: 43729 - protein, 162 aa, A.fumigatus
MARTFQPRGEDADARGDWAPGGDAHAGGDRAAGGDADAGGDWAAGGDWAAGGDADEGGGGAAGGHADKGGGGAAGGDVDVGGHADAGGDADAGGDGAAGGVADAGGDWAAGGSGAAGESGAAGGDGAAEGDADAGGDADAGGDAGAGGDADAGGDGAARGDA

SEQ ID NO: 43730 - protein, 232 aa, A.fumigatus
PRPLQRRSLMQPRPILHLHPLLHLHLLMHLHPLLHLHLLLQPRRLLHLRPLLHLCPVLQLQPLLYLHPLMHLLVQPRPLLHLRPLLHLRPLLHLRPLLHLHLLLQRRPLLQLRSLLQHRSLLQPSPLLHPRPLLQLRPLLRPHPLLHPRALPHPRLLPQPRPLLYLHALPQPRPLLHLRPLLQPSPLLQPSPLLHLRPLLQPGPLLHVRPLLEPSPLLHPRLHHGAGRCAPF

SEQ ID NO: 43731 - protein, 326 aa, A.fumigatus
  UNSURE (78): Identity of amino acid sequences at the above locations are unknown.
PFIKAPTPLGPPPPGLLLILLPARSPPGRVSLPATGSLSWPCAPSCTRVPSCTRVPSWICFPSCSPKLSCICVPSSSXDQSCTCTPSCICISSCSPVPSSAAPSCSPVPSCTCIPSCICISSCICIPSCICISFCSPVASCICAPSCICVPSCSSNPSCTCTPSCISSCSPVPSCICVPSCTCVPSCICVPSCICISFCSAVPSCSSALSCSTAPSCSPVPSCIRDPSCSSVPSCVRIPSCIRVPSHIHVSSRSPAPSFICMPSRSPAPSFICVPSCSPVPSCSPVPSCICVPSCSPVPSCMCVPSWSPVPSCIRVFTTGLEGARH

SEQ ID NO: 43732 - protein, 323 aa, A.fumigatus
  UNSURE (75): Identity of amino acid sequences at the above locations are unknown.
RPRPLWDLPPPGYCLFFCQPGPLLDVCPFLQPGPFPGLAHLPAPGFPPAPESPLGFASLRAAQSFPAFVSHLQAXTSPVRAPPPASASPPVAPSPPAPLPHAAPSHLAPASPPAFASPHAFASPPASASPSAAPSPPASAPPPASVSRPAAPTPPVPAPPHASPRAAPSPPASASPPAPASPPASASPPASASPSAAPSPPAAPLSPAAPLPPAAQSPPASATPPAAPSPPASASPPASACPPTSTSPPAAPPPPLSACPPAAPPPPSSASPPAAQSPPAAQSPPASASPPAARSPPACASPPGAQSPLASASSPRGWKVRAI

SEQ ID NO: 43733 - protein, 87 aa, A.fumigatus
TDLYSMIGSIKSIFWLFNHKELVKVVDDPACILEDEIIAIPRNINPMGFLMSYYSELEKMPLFILQLYESVRPHSSPQARTDQRYLL

SEQ ID NO: 43734 - protein, 64 aa, A.fumigatus
HTYADLRATYPHSRIFSVFFHEQAASYEGKKQNTMNTFESTIVKGYLDKSRLHFTTQGTYLRLY

SEQ ID NO: 43735 - protein, 72 aa, A.fumigatus
YRLVADWCHALLSTDTLSLQLEQALEVSEKDVKHASAGVLQDLKRFQKDKEADLRRYMVGCPFAPTDDHANC

SEQ ID NO: 43736 - protein, 307 aa, A.fumigatus
  UNSURE (12),(18),(19),(21),(22): Identity of amino acid sequences at the above locations are unknown.
GGRGGRAIDRSXHGCVAXXRXXGWVSVNVENLSIIPFRDSSQGAGLPLLSRVSNVFAPTPIDPFKVAENGLDSIYVSAKSQMMETVVTVIPPIKYKLEYPSVHYAALGESRTFDIEYTDQFLDAVGGRVIESLLKSIEDPIISKWIIAALTLSIILNGYLFNAARWSIKEPEVAPVPAAPTVAVVEAKKEYPKIDLNPDTPKKSLEKCEAFLKEKRAAYLSDEELIELSLRGKIPGYALEKNMEKEDLLDPGWMRFQLKNGPKNSGPNPGWFGSQNSPAPLFPPKFQKGASLLGKMFSQKTLPPILN

SEQ ID NO: 43737 - protein, 95 aa, A.fumigatus
IEFTNCCSWVFSSELSASQSSGHAIYKPSANAQKLNGYTWKIQYGDGSSASGDVYKDTVTVGGVTAQSQAVEAASHISSQFVQDKDNDGPFSPLG

SEQ ID NO: 43738 - protein, 131 aa, A.fumigatus
CWSVQGQSYQNQGSSQSYPYGNQNQNPYQNPEHQGKPAKQDKLSGLLGKLQDTVTGLGSEVAQRVGNVLDPQQAYAEHGPNKPQSEHRFGSFAPPRQANDAKWYVDGCSYFYAVSKALESARESIWILDCK

SEQ ID NO: 43739 - protein, 183 aa, A.fumigatus
TGSVKVTTSFLSCDWNCPYPLGECMLSVGLLITIGTFSTVYKAEDLLYDHYKNDWDTFQETQSSNWSSPPAKRRRVEESVTKRRKPRYVALKKIYVTSSPLRIQNELELLHDLRGCRSVCPLITAFRHQDQVVAVLPFFPHTDFRIQYRTFMVADMRHYFRSLFTALNSVHKHNILHRDIKPT

SEQ ID NO: 43740 - protein, 117 aa, A.fumigatus
  UNSURE (5): Identity of amino acid sequences at the above locations are unknown.
AELTXYPAPFSPSIGRNATQPKIIAPASTFKFIPKDDRIPPSAEPVDSHGFPAGTHWVDFAKPGTIAVLEQPANQHCAVLGGIMAVRMKVLGVRGVLVNGRVRDVQESSPRKWQDQR

SEQ ID NO: 43741 - protein, 181 aa, A.fumigatus
TQCGSRRLCENWTCSTYIYEDGNRLSKADHNLARPLSTKVKPPFESSWWAKLFTELTQDKQMAEKSGRHQNADDHIRQFFRSLSAVQEIRAISQNSRRVSQGSGHPGDCSKRMAILLWKFRQTLPDEVGLTTWRKLIPPPDRTMMNSPKPATGIDLPPLSLDSILLKPHPPNVYQNPQGHD

SEQ ID NO: 43742 - protein, 155 aa, A.fumigatus
  UNSURE (128): Identity of amino acid sequences at the above locations are unknown.
SFSRTLSTSAPSRRSRSASRTLRRSGSAPYAPAPQLAIPPTMVAEAAAPVRGSKSSSSSSSSSSRLSALRSSSRWASSIRFLTSAAIRIPSETMLSRTPRRPFPGGTMPPDAPPTGAPDTVLPGALSXPMFEKVVRLHYKDMVVDARWRMIGQTE

SEQ ID NO: 43743 - protein, 88 aa, A.fumigatus
VRAVSSNTLCRPLQRTRRLTNAVMSFTSMFYKRSEQPLRMSLWMSGNGMATMIGALLSFGVGHSHNTNIHSSQLIFVLTTAKKDRKCV

SEQ ID NO: 43744 - protein, 116 aa, A.fumigatus
SQISVSKARDILGLLLFSTLGTPDPFSYNGADFANPTRYVFWAIPANLLIQRLPLAKYMGGVIIIWAGLVIAHIGAKNYAGILVLRFLLGMAEACVSPCRKFQYIVSSIAADSETD

SEQ ID NO: 43745 - protein, 139 aa, A.fumigatus
AGILRYPSFTPLVMVFIHAITTASTFDLALLQDTVQSLQLFKGLSRGSDRLYTICAAFSRTAQILVDSEETLEGLTQHRDGSLVMPALDSNIALPNVDWPENVFDSHMNSTDISMFLNDFIGTHRSVMDILNSDYVNET

SEQ ID NO: 43746 - protein, 156 aa, A.fumigatus
LIRPTPLSVIHGATHTTPPPAVPAMKIMRRNDGDRPSTEGSTAASSSVPSKTTSEVGDSGNDGERGSSAGATPAKDRMALTREEREAKYQEARERIFRDFPETKSSDISDQGTSMSRSSSTSGRKKTHRQKTPHDDSLDARSQFYAIMRPGLDYSG

SEQ ID NO: 43747 - protein, 215 aa, A.fumigatus
  UNSURE (4),(5),(6),(13): Identity of amino acid sequences at the above locations are unknown.
KFPXXXGCGEGIXSRMSPDEGMAVSFLSWNMLTSQPLLRNLPPDSNFAKALVLGIALAANVGGAASPIASPQNIIALQNMYPSISWGTWFFISLPVCIISILLIWLLLLATFKPGRDTTIVPIRPVKDQFSGVQYFVTIVTLSTIGLWCVSHQLEHVFGDMGVIAIIPMVLFFGTGILNKEDFNNFLWTIIILAAGGLCLGKAVISRPGLDDHGL

SEQ ID NO: 43748 - protein, 89 aa, A.fumigatus
  UNSURE (6),(12): Identity of amino acid sequences at the above locations are unknown.
TVEYPXRRVSQXPRDSPDPTGHGLEHHQPKSLGNRAVQEEVSRSICTSQWFSGQETCENYMIPDSIKETVDVSFNLRIAVSSDNQKLER

SEQ ID NO: 43749 - protein, 288 aa, A.fumigatus
  UNSURE (10),(30),(48),(57),(68),(75),(110),(119),(277),(283): Identity of amino acid sequences at the above locations are unknown.
IRRCPNRPEXPEANLRLPGYLLRYNPDLTXVYPFRLKDIYKEPAQPDXVYVASPGSXGFQLLLYLRQXRKPPVVXLNFQTDLSAYSEIILPSPLSRWSVWLLAVVQGFLXSIPAVHTIXYPSSSILRYLKDAGAPATRAVKLGRGVDTILFHPSRRDEAFRKEIAPDGEIILVCVCRLALEKGFEFLAVAAAKLAEEKLPFKLLIVGGNRNPEVERNIHRLFDTVRDHVIFTGFLTGEPLARAYASGDLFLHCSITETFGLVVLEAMASGVRAVARXLRDPPXWIFHC

SEQ ID NO: 43750 - protein, 62 aa, A.fumigatus
RRLGGSANETDVSARITAQVALATRPDFLLSKPGIGADEGLMILTNEMLRGIALAKRAHCKL

SEQ ID NO: 43751 - protein, 190 aa, A.fumigatus
  UNSURE (45): Identity of amino acid sequences at the above locations are unknown.
RIYMVPSPGSICAAHLHYHTRCFPLCQVSQTWLNAMWRLVIRRSXYNIEKDKFRAVTGIQLHYTQAGGITGHVMLVCMMLMYTISHHRIRQQSFETFWYTHHLFIPFLLALNTHATGCFVRDTPEPTSPFAGKRFWNHCIGYQGWRWELVGGSLYLMERLYREIRSRRATVITKVIRHPYGKRHLRDCSA

SEQ ID NO: 43752 - protein, 140 aa, A.fumigatus
ETAIHDHFLLLLTTAFPSHFISSIMAANGLYNIYRLAIPVATGAMIFNASIYDVRGGTRAVIFDRLSGVQEKVVNEGTHFLIPWLQKAIIYDVRTKPRNISTTTGSKDLQMVSLTLRVLHRPDVPKLPVIYQVSPHCSKA

SEQ ID NO: 43753 - protein, 99 aa, A.fumigatus
LESRAVLQNVPIAYRGWGQVLRKGNSGILVCHPDFLDTDVSSWWSTLLGEEGRAFDVRRFFVNCINPMGCPYGSVSPLNAFKGAHGPAFPLTTIRDHVR

SEQ ID NO: 43754 - protein, 102 aa, A.fumigatus
LLPSYDSPTPDSTSLPQTAVSPHQNLTFDSWIPSTNLATVDPMDQPREFLDWRQLFSFTDPDQPVLPMSMDGLPELEDEWRQIYWQETPMSDLLQDGGWMHG

SEQ ID NO: 43755 - protein, 199 aa, A.fumigatus
IFCMAVFIGPFAAPFVGGFITMSALGWRWTMYISAIMVLLGFVLVVLFLDETYAPVILVRKAATLRRQTHNWGIHAKQDEVEVDFHELVRNNFTRPLKMLFTEPILLLISLYISFIYGLIYALLGAYPVVFQRVYGMNMGEGGLAFVGLIIGELLGGVFILFLQGSYIKKLAANGDVPVPEWRLPRAMSSQRGWKDPRF

SEQ ID NO: 43756 - protein, 115 aa, A.fumigatus
  UNSURE (5),(23): Identity of amino acid sequences at the above locations are unknown.
IYASXYLTQSYGLYAASAMAGNXVIRSILGGVLPLVGSYMYAGIGPNWSGTLLGLLEVAIIPIPFVFYKYGYKIRRKSALIMRMQMDQMRLEGKRKRLVQRTEGNAATEQVKVEV

SEQ ID NO: 43757 - protein, 114 aa, A.fumigatus
KTNSLTFFIFAKYIDWRVRWRKLVYFTKELDSPDNGGRLNFINFETHRIDLCIDFIRQLKDEHERLNGPSRDELCVVATGGGAYKYYDKLKETLKVNIIREDEMECLITGQSTG

SEQ ID NO: 43758 - protein, 141 aa, A.fumigatus
QVSLLDNLILCISGAKTQPPPAPGLDFFITEIPNEVFTYSEAEPMQFAEARPDVYPYLLVNIGSGVSMIKVSGPKQFERVGGTHLGGGTFWGLMSLLTGTRNFDDMLAMADRGDNSGVDMLVGDIYGMDYRLHLGTGRSRA

SEQ ID NO: 43759 - protein, 166 aa, A.fumigatus
TGSPRTPQDHLFPPDPSGLSISAHNDQHPLQPDFNSSNLPATPTGPRDSFMQSGKRPILSLSGYHAPDVDPSLTSRLEQVELVGTGEFSQVYHVAHAHEMSLTSRFSLPNGAESPHSLPARVWAVKKSEQPYAGLIDRERRIREVDVLKALTNSDHVISFVDSWED

SEQ ID NO: 43760 - protein, 179 aa, A.fumigatus
  UNSURE (7),(16): Identity of amino acid sequences at the above locations are unknown.
PNAYSDXSRPFALSGXVWSCVGQIVVKLFPNQVRKVLLEWKLSKLGSCALLVLIWSTYDGAFASNAFAEIPSNNMVFTVFILVALFCLWITIAFVISRVWLSREDTIAVSYLVSTKTPAMGVPLTTIMYKGLSAAQQSRTRLPMVIFHAIQIAGSSLLTIPLRKWHAQRNAEETGDGTV

SEQ ID NO: 43761 - protein, 122 aa, A.fumigatus
RPPAPPHRPPDPAVAQLHSFSSGPRQSSYSCRHPSYPDAWPTRLAPPDSACAPTPSSFLDLIPRKAFTEGMAYPPPFPFASGGNSQNSRSSPPLSPLFVLRVFFFSPRIPQYLPKFVSASSF

SEQ ID NO: 43762 - protein, 129 aa, A.fumigatus
TPSEELDPETKKELERKRNLEERDELAKRLDKKDDGKSKKIVEDRTRTSEVARRRDLADDAAARAAVMHDLRLRSRQEYLKKREAERLALLRQQVAEETAEIRENPNLTRREKEEYARNREVLRIAEER

SEQ ID NO: 43763 - protein, 124 aa, A.fumigatus
  UNSURE (113): Identity of amino acid sequences at the above locations are unknown.
RIDDHRDGYMMPEDYITEKGKIDRKKKEEALYKRYVDRDERGQERFITEHEEWEMEQTAKAKAQIKRAEFVDEGDYEYVFDDSQKINFIMDTKLEGNRKPLTQERRPPSGEFXLRGRDGRSTFG

SEQ ID NO: 43764 - protein, 132 aa, A.fumigatus
KLSPPTAQVIITSSIAGFIRQVPFSFAYSLSKSATNHLVKMLSTTLSSYDIRVNGIAPGLYHSEMSASAFKGGDRGISDGSFPRERIPLTRGGSEEDIAGLILWLASASGGYMNGSIIVTDGGRTAVHPASY

SEQ ID NO: 43765 - protein, 143 aa, A.fumigatus
  UNSURE (141): Identity of amino acid sequences at the above locations are unknown.
TDQVNALQDLGVAVSTINSTTPLAERRLIIDDLLSGHPRTRLLYVTPELCQTVAFRRTLQTMHSQGELIRIAIDEAHCISEWGHDFRPAYKQLSWFRCHLNQPPVPISAFYGHSDPTCARRYHRPPWIRSCLLADEAGRFXDN

SEQ ID NO: 43766 - protein, 112 aa, A.fumigatus
EFGAKIIVGGRKIIDDYNVQAARERGDVEGELAVPEDKLPPPGEPYNKNQYVAWHGASSVYHTNAPSLPLPTGKAIDSKKRKVTVTGDNWMLEHAREARYVLAPLRLSLLDG

SEQ ID NO: 43767 - protein, 113 aa, A.fumigatus
ACPGGQVCPRTSSSLSVRRMTNAFTSSFNSLILNARRANLEGVYDIHTNAIHYPKIMQPSHARWERVPPPDPRATAKLAKGLSTLSLTNGTDEGEAEPPADHVFTTGLEGPRQ

SEQ ID NO: 43768 - protein, 168 aa, A.fumigatus
  UNSURE (168): Identity of amino acid sequences at the above locations are unknown.
NHRRHTHRPSNDQETIRLTTPSRWLIKAKTPQVLAMLAVFLVGPGLIGGEVLDLLLKEKNYEITTLVRRDAARPAFHELGVQTILGSLSDKDVIVQQTAASDIVIHSATADDLPSVQAILEGVRQRTQRGQRTIYIHTSGASLIGDNAEGSYRSDCVFDDETPSSIDX

SEQ ID NO: 43769 - protein, 64 aa, A.fumigatus
LRLSVINSSKTAYAAFVFDGASFFTTYSFSHDGQSENVWSDRFCCQVYLKVRVAQSRALCDETD

SEQ ID NO: 43770 - protein, 196 aa, A.fumigatus
  UNSURE (172): Identity of amino acid sequences at the above locations are unknown.
FTRYLRPPVREYANVLVTANMSQVQSPLKSPIKSPSTPAVPASSTRSSISGPSRPSAVKARPPSGPKTSMGPPPPPSVAARQSRSSISGPASKAARPSLQSEPTTSSGQLKRPALRPTAPNKSSEETESHTSAYSGDPEIDPRDAEPDMDGNEAPTRKVSEKALSSGRPAGXRPSLTSSLQRQAQNNSAAVARELD

SEQ ID NO: 43771 - protein, 118 aa, A.fumigatus
SLYTKKSPDSYPTHLMATTNKQPVNIITHTFHPTTLIAPRTFISLVISADLPNFVRQGFMTVQIPLAAKPTDAVPDEIREKVASAAPRNAVFASYASVEQVVSLVFTRRPWKDPRIAY

SEQ ID NO: 43772 - protein, 158 aa, A.fumigatus
KSGKLMTPNLGDARAYMYSLLNQPSSQNNGTHAGKFDVIDLDPYGTAAPFMDAAVQGVKDGGLLCVTCTDAGVWASNGYPEKAYALYGGVPIKGSHSHEGGLRLILHGLATSAAKYGLAIEPLLSLSIDFYARVFVRVHRSPAEVKFTSGNTMLVFNC

SEQ ID NO: 43773 - protein, 238 aa, A.fumigatus
QVSREEYCCGVILLDDDDWPGVIRAAGDFAVDFGRVTGTNYTTGLINGTTLHDQSSVRGNRGVIIAGTIGRSRLIDSLAARGKIDVSQTKGKWEAFQTEVVSNPLEGIPNAVVISGSDKRGAIYGLYDISEQIGVSPWYWFADVAPAQHKEVYALKKKKIQGPPSVKYRGIFINDEQPALTNWINENYPPARYGPGFNANFYSRVFEYLLRLRANYLWPAMWHNAFYPDDTGPSPRGQ

SEQ ID NO: 43774 - protein, 182 aa, A.fumigatus
ARGGAYMIHITAELGGKAPVCLFPSLDVELAVKAAMFASFIASGQTCVTGSRLLVHADLYDRFKDLLEKRVRALRVGDPMEERTQIGSVISRAAVERCSAFVLRAVQEGGRVLCGGNPTNSNGKGFFFEPTIIETHADSDLATNEVFGPVIALVRCESEEEIIRIANSTSYALGASVWTNDF

SEQ ID NO: 43775 - protein, 253 aa, A.fumigatus
  UNSURE (8),(14),(25),(64),(241),(243),(244),(247): Identity of amino acid sequences at the above locations are unknown.
SRWRPWKXIPNPQXRAGPASLDTVXSDLSGILPTGSSSLASGVATTDSSNADGTVTHSTVVIPXSTGNNSSPEASPSPTPSPSGVLDPLTSAVTDLLPGSASSSAVTNGSSGAETSASTDLGQSTVPVSVPAVTPSATSSSGLGGILGPILSSAGSTGVIPTASTHTSSFVGVPTGLTSILIPGGSSGSESPTSYTQISPSVPTTAPSVTSTAVIPGSSDTAIGSSIAVTGSTGVSSSPLXFXXRDXTRALNR

SEQ ID NO: 43776 - protein, 73 aa, A.fumigatus
SGRICEIARRRGMTIHGAIVVSRQVEFYKMKRDGSFECMTWLAQEKKRLHILRDMRTITSHLMQINYEVRLRD

SEQ ID NO: 43777 - protein, 106 aa, A.fumigatus
  UNSURE (97),(99),(103): Identity of amino acid sequences at the above locations are unknown.
SPTKRIRVLLAHCFARASSFKSPKLPKLKTTNRYSPLIHTMSPTLPPEVVSNILSHVTPLWHWRRRAMWKNNCERITAENDVRWFLRIRGACRASFXTXAAGXNSK

SEQ ID NO: 43778 - protein, 144 aa, A.fumigatus
QTPLDAFVSPSSNYVSDGFTDLFPVSSSLDSSLKKNTAFIKRLRTGINASVLQTFLTDIRTLSLHKYLSEIISACYEGLCKLKSPGEIAAGVEVTSALHQRFGPDEFTRQIGWLLGRGLSTPDKSQLRTLSQEFSTRRRQDRCK

SEQ ID NO: 43779 - protein, 179 aa, A.fumigatus
  UNSURE (91): Identity of amino acid sequences at the above locations are unknown.
RLDERMQSEGLYDCPYSSYAVESIRYLVLFVLFVTCLHYSYYALSGLFLGLLWHLLAFNVHDTGHLSITHGFHTDSCIGIFIADFLGGLSXGWWKRNHNVHHIVTNSPEHDPDIQHMPFFAISSRFFGSLRSTYYDRDMKFDTAARFFIKYQHYLYYPILLFGRFNLYRLAWAYLLDTA

SEQ ID NO: 43780 - protein, 88 aa, A.fumigatus
AISVFATTVPPGCPHSQLALDTNNTSQPVQTWRRLYESSNSNGHPGQNIFFYLNHPIRFVSLVGVIVARTDVFKRTILTLDYIIGETI

SEQ ID NO: 43781 - protein, 253 aa, A.fumigatus
SSLCETSQFHNAASTGIYETFFLCEMGYLFDMLEKANGQNCQATNFLKTFSSYREASNLGLLEENLTTKSLSSAIQSVNRFFLNQIAHDFRMIVPSSDDLDHRLSTIASESIRCMFCQNEIVRPGNSLANELIYPTIDIKQARRNPAFRFSSILRASIERETQNRGWCNYCRRYQQVTIRKSIHRMPLVLILNAALSNAICRRLWSIPGWLPEEVGIAVDNGQVMCFEGDELKTQLQNKLPHLSSPRVADRIG

SEQ ID NO: 43782 - protein, 232 aa, A.fumigatus
  UNSURE (12),(13),(20),(58),(59),(74),(77),(88),(144): Identity of amino acid sequences at the above locations are unknown.
SGVIPSHQIKIXXTKFPLPXADGTIIVGQNSISHPSEATAFQLSTGSRRPSFFFADGXXDLEDTEPSDASDAAXYEXDHFPGSVPTFXNKNIQFSKSANEDLPARITRIWYINPYGQEIRPPANPRVLESLRNAQAIIYSIGSXYTSLVPSLILRGVGQAIATSPARHKILILNGSLDRETGPPSQPFTAVDFVEAITRAGEESRGRPVHLPSPPYSSYVTHLLHLEAVFTT

SEQ ID NO: 43783 - protein, 191 aa, A.fumigatus
AMETSRETLQALSLVNHTWYQAAVPFLYEKLQLCLTTTPQLQEDVEQLMKHSLRKQYLRYLRRLDLVGRSGKRSLHLAALQEDAEGPIMLDNFLDRELWQRHTFRLCRGETTTPDYASLARFIAAVSNLRELNWVRALRFPQEVLDALHKYHPSCKLNLLYFYLQAWKYQGLSDNDMTVVTSPCLHTIRCY

SEQ ID NO: 43784 - protein, 110 aa, A.fumigatus
ALINLPIAAFVTVDPSTGSHISKLCRRLRIPVNVSDAPDLCSFNLLSTYSDGPLHIGITTSGRGCKLASRLRREISASLPPNLGTAIDRLGAVRRRLWAEDYAAGLCDGI

SEQ ID NO: 43785 - protein, 75 aa, A.fumigatus
  UNSURE (57): Identity of amino acid sequences at the above locations are unknown.
AMMSSCISLTRLADGRVDVDLNSRIARTLAQIIELQQEDIHNPPPDYQQELQQQRDXDQDHQLEPIECSIHLNIV

SEQ ID NO: 43786 - protein, 121 aa, A.fumigatus
  UNSURE (114): Identity of amino acid sequences at the above locations are unknown.
WRKDIQQMSLCEFPSLEVRLLLLTDHLTQWSNFEIGSLEWLRSKQYLDYFDALDHDGGFFYERWGDAPVHSIAAGIMLKKEEIHFFNEIAYYHIPFTHCPTSEQMRLDVLHHGXEECRSSS

SEQ ID NO: 43787 - protein, 125 aa, A.fumigatus
TRKKVSPRGVFFSFFPLFPPGPPISPHLGNGLGNYRRYYWRVEPSIELYCDISFDPFKLMKEQNKKYSFVLSLYEYYDTIPSLWDSVKKFMGNHPEHIAEGNAMGFLSDDGGKTYNKCHFVSFPH

SEQ ID NO: 43788 - protein, 138 aa, A.fumigatus
LWSFQPRGEDDEICGIFARASDPELRAISQAFGARYNSSLESHIEKEFSGHMKDALLHMLRTALDPAMRDADLLEDCMKGMGTKDEKLVTRVVRLHWNRQHLDQVKRAYHHRYKRDLIARVRGETSGDYQKLMVALLE

SEQ ID NO: 43789 - protein, 174 aa, A.fumigatus
GLYTETPMANSELFDQIRQGKARWLRGDIVSLTEDGVMFNHRSHGVPKGGPGHESVVPGDVIIMATGFKRPSLNFLPNDCFEDPYGPPSWYLQVFPPKYTSICANNSTYINAIGTVGNMHIGIYTRFLLMFLVDPLSRPTEGRMKTWIDFTRFMKRLAPTGAFDFFTYAELIYW

SEQ ID NO: 43790 - protein, 106 aa, A.fumigatus
FSFVCGHSDSPASDPPFDSLFLFSPRSLLASLSLSLFPSRDFSFEKLSSSLPVLPCLSCSFSAPASLLPSLRRTELLRALIILPLAPPFPPLLLLFASLASIFGLV

SEQ ID NO: 43791 - protein, 227 aa, A.fumigatus
  UNSURE (214),(225): Identity of amino acid sequences at the above locations are unknown.
GRQRSKNKRGKKNHASQTSPKIEAREAKRSKRGGKGGARGRIISARRSSVLLREGRREAGAEKEHDKQGRTGREEESFSKEKSREGKREREREARRDLGEKRNRESKGGSEAGESEWPQTKENQEEERSSSAKAKKNPEEGRENQRVEKGTVRRILRADTRGGEQEAAGVEYLDENGQMRTATARKEVILSAGALRTPPILEASGVGDADRLTXHLGQTARTNIXKE

SEQ ID NO: 43792 - protein, 73 aa, A.fumigatus
WWHNPLPTPPQFPTARQAGIHIRNTRPSRHPKAGNGAKINGVRKTMRLRLARRSKRGRQKGAKGEEKGEQEAE

SEQ ID NO: 43793 - protein, 161 aa, A.fumigatus
RQSSLSTTSSTSQGVKGYRRMPRTRRSNRLSGARTRYTSDPFEVAGVSDESDSREGIGPSRLNAKQPVRADDSSDEEYKEVQNEQDEAEEGEDEDVEMVDVPGDDDEFVSDEEDEIDSKKPKSAGVSRVKNPKRRHDDGSVAIAEDETHFRGTWSPGEHVG

SEQ ID NO: 43794 - protein, 157 aa, A.fumigatus
VSSSAIATEPSSCRRLGFLTRETPADLGFFESISSSSSETNSSSSPGTSTISTSSSSPSSASSCSFWTSLYSSSEESSARTGCFAFSREGPIPSLESDSSLTPATSKGSLVYLVLAPDRRLDLRVRGIRRYPLTPWLVDDVVESDDCLHHGGLEGQQ

SEQ ID NO: 43795 - protein, 138 aa, A.fumigatus
  UNSURE (137),(138): Identity of amino acid sequences at the above locations are unknown.
EAVDAPKTWSGGNCHVQPLPPSVSVMSGNITYPISPSRPPLLFQSIVARHLVDFNFRITYLLFCSWTLQIYDRVTAVMTNSDPKNKCCGTDCDNEAGTLQCPTCLKLGVKGSYFCSQECFKKNWVGNIQDDIPRPPXX

SEQ ID NO: 43796 - protein, 151 aa, A.fumigatus
RPPLRLNPKRSAQITKLRDTANQAYRKSNYAEAVKLYTYAIDMALSRPGWEPVNLARDELSGLYANRSQAHMAQQAWPEGMIDAKASCDCKPIGNVKAWWRAGKCLAEMGRWEEAKTILERGLDIEGKTGEGGKELGALLEEVQQRLQKSA

SEQ ID NO: 43797 - protein, 66 aa, A.fumigatus
NTKMDTSTKPSSSLPSSNPPSVEGAYKRKCIALKKRLNEIEAENEMMRMRNKRGWQYIQKMRLESC

SEQ ID NO: 43798 - protein, 93 aa, A.fumigatus
IDGIDEDSIAKPHRPLPSGRITPGQATLLYRVLFFLMWVAAVYTNTISCTLVYSIAIVVYNEGGLAAIPVVKNLIGAIGLGCYCWGTTIIFGI

SEQ ID NO: 43799 - protein, 100 aa, A.fumigatus
  UNSURE (56),(64): Identity of amino acid sequences at the above locations are unknown.
GPNNLHHNRLDRTAVQTLLHQYSSRAKSDGHLINASKQDSQCVEHGVFLSYVHVEXLSWLTKHXYTVPASSVKWYSWRKLSSRKYLLPSSPRGWAITRSE

SEQ ID NO: 43800 - protein, 154 aa, A.fumigatus
LRSGPRPCGHAAVICLCSQRTRDARCGRSAPLLRREFERHLRALELYRDLDDERPGGVGIYFISHVGGHKYAANVIIYRRRDFEWYRKENPGQDTLGKTTVEADEGAAQGIWLARVRPEDCENIVKYTVLQGKVVKPGLQLRGGFDRERGKISW

SEQ ID NO: 43801 - protein, 195 aa, A.fumigatus
NCIIDVLDESKSDSQETLMRQMDHSFNNPRRTCSAPSSIHLLILSRPYPELEQYLSAFKSMDLGSCREITNDLRAMIKDRVEGLARRRKYPKSVFEKVSQILEEKAAGTFLWVGIACAKLARVQSRRAVETLQALPQELHSLYRKLLLAAVSDCDEDDHRVVMEILGFVAFAQRPLTIIEVAEACRLYTSRQAWK

SEQ ID NO: 43802 - protein, 193 aa, A.fumigatus
  UNSURE (193): Identity of amino acid sequences at the above locations are unknown.
LLHSARRSTPCGEDVRLVEKMGSLYTQHYASTVGGSMTRNTFDLIYHGEVAGISNTRPLFAALIKGLLAPISGSEGININIVNAELVARERGIFVNEQHSRDPADHSYSYSSLVTLVARPPSRASSRAPAPDATSQTGPNPHDQRIISGTCSGDQPLINRLGRFETSFVPEGTLLICENYDSPGKIGAVGSLX

SEQ ID NO: 43803 - protein, 70 aa, A.fumigatus
KESQCVSLVSSWPVANSANLLGQEIFEKPQFFVNGPTASDVRQGRDGECWFIAALCTMGNKNGLIKKICV

SEQ ID NO: 43804 - protein, 130 aa, A.fumigatus
  UNSURE (7): Identity of amino acid sequences at the above locations are unknown.
DGSIAGXAHWRRPGRDPELVRKWMAGKEEWDKKFAKEKLRVQKQRMKELAHGFQDFDGDTAPPSSVAARRLAPGILPQKGGKHRKSYQMTLWSRMASKHDKKTLAREQAMQKEEGRSRLTSVDGGRAWAS

SEQ ID NO: 43805 - protein, 90 aa, A.fumigatus
HIHYIYTPSTLVAQSISTDTKRKHRPMNAGIYHPQHPHPKVHQHLLLYHRLFRPLVQTHPLLHPVPFTPLIRTGLPPSHLTTVPLLRRPQ

SEQ ID NO: 43806 - protein, 63 aa, A.fumigatus
LLHSLANGFAYWQGQELSNATNTYFDDMAQALGHIEQVAGSNADKIRFGNGETGWPTSKFCTF

SEQ ID NO: 43807 - protein, 80 aa, A.fumigatus
TAGGTNYGPAVASTANAADYYKSAVCGMLAWGVDVFYFEAFDESWKPKTKGDNGEMQDETHWGAFTADRKAKFDLTCPKH

SEQ ID NO: 43808 - protein, 75 aa, A.fumigatus
RRRIVGHPTKIDLLYALTDIGSTYRWEQELNKWIPVTDLVGPEDENLLGTESVATDIFIWRKAGSRVPITLRSSC

SEQ ID NO: 43809 - protein, 85 aa, A.fumigatus
  UNSURE (73),(77): Identity of amino acid sequences at the above locations are unknown.
HPRLSNWPHPLIMDNSDPFIMMAEANKTYGFTIAVKELRETVPNIFRYASAYMRKNNLKSKGLWEMFLEKPEXEEPXPDEDLISD

SEQ ID NO: 43810 - protein, 66 aa, A.fumigatus
MPPQSPDVNFDISVQVLLMQLRRRTDEVMQPVFREEFASKTMITVAHRLRTILVVIWWYSSTRGVF

SEQ ID NO: 43811 - protein, 124 aa, A.fumigatus
PTPSVPPSGRREKGGVATTASYVRPSNPPSPTTRSTAHPQPVALPPPAHAAAAETAPADPAEHHTRSSSPPSRRSSPRTYNSTAPAAGSRPRRLPSPPRRKRASSRAYPGPWRPGAGCRLWRRR

SEQ ID NO: 43812 - protein, 62 aa, A.fumigatus
  UNSURE (49): Identity of amino acid sequences at the above locations are unknown.
VKTNFGHGEGASGLTAVIKAVLALENRTIPPNMHFRQPNPFSKNQPLCXHPRRQRYHAMPRG

SEQ ID NO: 43813 - protein, 179 aa, A.fumigatus
  UNSURE (91): Identity of amino acid sequences at the above locations are unknown.
ALSHEAAKVLQTGSCSSAMVAGTNMFLTLSMSVTMSENMVLSPDGLCKTFDADANGYARGEAVNAVYIKTLDKAIADGDPIRAVIRATSAXYDGRTAKIFAPDIDGQKRLIRKAYERAQIENIAETAFVECHGTGTRRGDIVEATAIAQTFHPHGVHIGSVSTKPCFDTVLWILLTRSR

SEQ ID NO: 43814 - protein, 195 aa, A.fumigatus
  UNSURE (177): Identity of amino acid sequences at the above locations are unknown.
FDLRVTRDGNTLVTKHGIITFQPFETVLYQIKNFADSHKSEFIFLDLDLAHEDGVGGDVLAMLIKVLGDGKEDAFATAHVGPDGKMYNTDLTWAKLREDGKQYVVIYGEEEKVNGETKHYDSGKYWAPQAGNIRDNWADDYEDKSPQEIVNWLDQVLAQWKKEKLWITQFIDTPRPXYFVYRPGGKVLICPRKGK

SEQ ID NO: 43815 - protein, 164 aa, A.fumigatus
  UNSURE (161): Identity of amino acid sequences at the above locations are unknown.
WANSDAKHLVTIVLFTRVEYDSSALGGPLPLSSESLRCISSPNHAPTRDFYRVVVNDMASGHWTTILDELKKDFRTFLRDVSILKMDRPDTPTVDGVKVAPKNKPAIIAGRPSTALRGNILEAIHLASAHLAYDHIDRDLVHTGTSIIGTTPGIFNRPDAXTEE

SEQ ID NO: 43816 - protein, 247 aa, A.fumigatus
  UNSURE (50): Identity of amino acid sequences at the above locations are unknown.
PIGKHNVTGSNACLGLFPFQHRMATKLSGGNKRKLSLGIALMGNPLVLLXDELSSGMDAASKRVMWKTLASVVPGRSIVLTTHSMEEADALATRAGIMAKRMLALGTTDDLRKRYGNKYHVHLVHSQAPHTTDETMERIRDWVQKNFPGAVIEQKTYHGQIRFSIPATAASSSPKAEITEYAAGPIAEEEELGPGPRYQSVNKSIVSSIFSKLEQSKTDLGVQYYSVSQTTLDQGLHHGGAGSANKY

SEQ ID NO: 43817 - protein, 177 aa, A.fumigatus
  UNSURE (1): Identity of amino acid sequences at the above locations are unknown.
XKGRSSAGLHSQPPGDGVLDHLPIGGVSAGLIPSSSSAPQARAKDVPYKEILLQMDPSGIVLLLGAILCFLLALQWGGSAKAWGNADVVGTLVGFGLLLIAFAINELWLQEKAMIPPRLFKGQTILFSSLFTFFFSGSFYLLLYYLPTYFQSVKGASASDSGVRTLPLVLGDGLFAT

SEQ ID NO: 43818 - protein, 181 aa, A.fumigatus
ATMTAVVKTSIRIPEDVFPTITRTPGSMINFRYYVEVVVDLRGKLTSPERFLPRFNMVSSGSNFSPSGQVLNPSDANGNSITTNWAGNILDTAQIRREKGVVAVAFEVVIGTRDSQRHKEKTERTHSVAAVSDISPPQAHPAAESDHWQNGYSPMPTTNSEYLPQTDYGFPVHRPGGEDPR

SEQ ID NO: 43819 - protein, 106 aa, A.fumigatus
  UNSURE (91): Identity of amino acid sequences at the above locations are unknown.
AGTWARLPSFYRENTSDTIVDYTTFLVADEKTALDEDTLLLVYDVEGLQESIRLSACFANSEAVSVSVATKDVGELWTLADEDGVYRGGPXHPPPKKGGKAPRKRL

SEQ ID NO: 43820 - protein, 139 aa, A.fumigatus
  UNSURE (9),(10): Identity of amino acid sequences at the above locations are unknown.
HVSFSRRVXXFFTTDCYGGPKQYNQFPVDKKHAFSMIAELFAPKSRGTVTLKSKDPKENPVIDCNYLSDPLDLLVLTEACRFGNEIVMNGAGTKDIVKGSWPPNLKHHTYKTREEWIPYVKEHATTCKSSVLATRRSYI

SEQ ID NO: 43821 - protein, 63 aa, A.fumigatus
VIRTRNKTVLYLTDGIGYHAAGTCAMGKDGDSMAVLDNKLRVRGVAGLRVADCSVMPTLHGGH

SEQ ID NO: 43822 - protein, 165 aa, A.fumigatus
  UNSURE (151),(154),(157): Identity of amino acid sequences at the above locations are unknown.
VQLTPRRVYNCRTRTSLPPVLTLSTPEMDDDVLKFVLRGHLLDCYEWIYFPYLLEAIAHAAPRNPATDEFVVRGLAMAAERIHKNRKGFRHRHHGVWLMLRSCTRSALLLVAASRAAGGVRDMLPVGWKAAVRGAVEMLAYWRDDAGDARXRLXVLXDVVAGWGE

SEQ ID NO: 43823 - protein, 149 aa, A.fumigatus
  UNSURE (148): Identity of amino acid sequences at the above locations are unknown.
RPVACITAERGLPFHPSSPSPPRKWTTTCSSSSCAATSSTATSGSTSPTCSKRLHTQPRATRPPMSLSSAASPWPPSASTRTARASATVTTASGSCCARVRGVRSCWLRRVGRRGVCAICCLWVGRRRFGARWKCWRTGGMTPGMRGXG

SEQ ID NO: 43824 - protein, 171 aa, A.fumigatus
PLVTCPHCLSEVKTEREVVAAQAHHRGSDSTSGHKTPPPSLRRRKSRCSVQKGSPPNRVTKRKTQVKPNIRASASKQHPAKSKTKGHVFVCSFSRYGCASTFASKNEWKRHIASQHVQLGFFRCDVGNCNGGHKPNNKMTSTSTLNHHDQPGHQTNDFNRKDLFTQHQRRM

SEQ ID NO: 43825 - protein, 77 aa, A.fumigatus
HRDISILIRSQRLPHLLLYGPPGTGKTSTILALARRIYGSNNMRQMVLELNASDDRGIDVVREQIKTFASTLHHTLI

SEQ ID NO: 43826 - protein, 120 aa, A.fumigatus
KKSVVMSLYNAASAAGNIVGPILFSSEDAPTYHPGLQACLGIFVALVAVVLIQWADLFVLNKLQEKKRVRNGKPAKMVDRSMDDHYHGTGGDEEAMQEELGNNGLLDVTDRDNDEFVYIY

SEQ ID NO: 43827 - protein, 74 aa, A.fumigatus
SDLKSFQILWILFLLHAATMCNYFKNYYIYSSCREPSQHFIRTSVDGAKESKCPDSPHDRFIVVVGKCRLCPPR

SEQ ID NO: 43828 - protein, 107 aa, A.fumigatus
  UNSURE (5): Identity of amino acid sequences at the above locations are unknown.
LPSVXNSRASGESRGEDLAHDLRPRALQWDGVMHGNSACALPPSINSAVPFPAAHMAAPQELLLLSPQAPADPGSSQGSPSELGAGGYPDVNTTSGVRLILLYPSTG

SEQ ID NO: 43829 - protein, 70 aa, A.fumigatus
CVVSNVTPEDQAVVTACSYLFRSLGSVIGVSLSSTVVQQLLRSQLRFALRDSKDIDRIVEGVRQSLDYIK

SEQ ID NO: 43830 - protein, 171 aa, A.fumigatus
DPEDRERIADVVFRRMRDDHQRLLTDVRRDGIDERWRRRAFYTDVEDGATAPEGYVSDPDVDHLSEDEDAPGHPSALDSHPPSPRSRSSSKVRFQDDLTDDYDVRSNPSTSSRSIPVGERWGGFEIPEVEKDVGKEILYQVTQQGFNELLDILFKPNEVIATDLTNPHSRS

SEQ ID NO: 43831 - protein, 178 aa, A.fumigatus
  UNSURE (1): Identity of amino acid sequences at the above locations are unknown.
XKGVSLSTRTIYSMAELSIGLFQEDDLMERSLASLPDTAIPIITDYIDKLCHATDLCKDHSLHQCLDGDNTPGMDEEALTMVKVMQQNIERWFRFVLGEDFTTNASSSDRLDLEQEVKLATLAATQRARENRALSNSSGNSHTEHVTLRSGQNFYTWLHTSAVHDVKSAVVSKALICT

SEQ ID NO: 43832 - protein, 68 aa, A.fumigatus
TGQCRLTSQLFLWVFFWTNRWQVTPVAEFNAYADAFAAARVFALTSPNPKTTMPSGTTLPSYPAKLSK

SEQ ID NO: 43833 - protein, 161 aa, A.fumigatus
  UNSURE (4): Identity of amino acid sequences at the above locations are unknown.
FHSXLAAGCVRHMFEPSADPTVIEPIRTGDSAHRSFIASKRPAHQEILRVLRENDPDTVTLVAVGPLTNLALASAEDAETFLRVKEVVVMGGAVNEPGNVGLPPSYSYGSFSGLTGGRSHPLQSSTHTPTHSPRRAFSPSPPLTPKPPCHPAPPSRPTPLN

SEQ ID NO: 43834 - protein, 66 aa, A.fumigatus
APPFLNKAGSLTPEVKTTVENIMIINSIIILHYILYSNISRNSPTLGRIVPPQIRLKRAIKARSPS

SEQ ID NO: 43835 - protein, 172 aa, A.fumigatus
  UNSURE (101): Identity of amino acid sequences at the above locations are unknown.
NAALEAQKKAAEANDVPKLVSVQQAIKFNGGGHINHSFFWKNLAPEKSGGGKIDQAPVFKAAIEQRWGSFDKFKDAFNTTLLGIQGSGWGWLVTDGPKGKXDITTTHDQDPVTGAAPFFGVDMWEHAYYLQVHLHSLRLLFFCSPCSFANESIVLERQSLVCQGHLERDQLG

SEQ ID NO: 43836 - protein, 120 aa, A.fumigatus
VAEPIALTSIFPYSWVMVKDFRVADRTDASLYAGILVSAFSLVEALTGMFWGGLSDRIGRKPVLLSGCFGTVLSLLLVGFAPNFWVALLGRALGGLLNGNIGVIQTMVGELVKRPEHERK

SEQ ID NO: 43837 - protein, 62 aa, A.fumigatus
  UNSURE (12): Identity of amino acid sequences at the above locations are unknown.
QSGKFQHLTPHXMYPVDDPGALQYLCMGVAAQMTSSRYVSTKVPVEVIPRYLYCNYKYYPKI

SEQ ID NO: 43838 - protein, 174 aa, A.fumigatus
  UNSURE (137),(150): Identity of amino acid sequences at the above locations are unknown.
TVASAMDTYRINRYNITEQKTYTNRLIQGALRYQKLNLSSAGELELSFVGFKPTVHEVPMSGLPGSFNCSDPVLNRIWEIGARTVQLNEFPARSLPDFWILTEEGALVDSLAPQPFAADFAATMSAYKVTFSVKPVXHGFGFTVLSDTLXNGIYIFVDVVNSSISAHAGSTEIG

SEQ ID NO: 43839 - protein, 114 aa, A.fumigatus
TFHRRDETLQPLTRQTVPTGLFIHNEFTPSSSNETLTVENPTTGSTLGTVSAATAADVERAVTSATTGFQTWRTTPGPERGRLLLKLADLIERDAEEFASLEAVDAGILYTDSM

SEQ ID NO: 43840 - protein, 78 aa, A.fumigatus
  UNSURE (68): Identity of amino acid sequences at the above locations are unknown.
ALSIVGASWGLVFASFSTSASAGKAQRHAKKGKSSKERQAEGSGPLMKRIVVDGCDLLIPGVFLVLTXGIEASALPPY

SEQ ID NO: 43841 - protein, 153 aa, A.fumigatus
FCFQPIDDSRPVRIDQQMPSALTHIFWSNTDVSTGITHKPYGVDWINFERNMYRLCVLQGKVRDGDKVPEDPWEMFLRELAPLTKRPAGQPQPSTAYFPTSILRSSVGNANANASGGPSAGQDGQHHVLFEVPLLRRSDENRRNVGRIPRYLN

SEQ ID NO: 43842 - protein, 178 aa, A.fumigatus
  UNSURE (168): Identity of amino acid sequences at the above locations are unknown.
PSSLVVKTADDQQNMPHSTQYGYGNQYCPYGKAGIYGQPHGFSYEHSSSPATEGSFNQSAPGRDSVYGRTGSTQPSETQQTAAGTNAFGAGMSDVFGRTQAGFGQNQPMSQQPPVTSDDTKSFKTPKAAGPSPSLAQANRPGSDTNNVPGQPQAQTGLPPLQSQHGQXGFSGIPHLNP

SEQ ID NO: 43843 - protein, 92 aa, A.fumigatus
QSQLVMQFALPPRRSPHTSSHTRSSRLSLQRKKQLKTAAILGFAILTLFFLLSHFSHSSTAPTSAPSGASSIVIVTDLDRARFAVIHRFLTS

SEQ ID NO: 43844 - protein, 135 aa, A.fumigatus
VRSKLPYQGKPIRGRPEISLGGSLTRYSWRHARIFPSLLGLRFTLGAFEAMIGMSSPARSDAMLTGLAPPCVAVTQMWWRRGEQTLRTAFWNGMNGVTFIVGSLFTYGLGHIHSDSLFSYQVPPFLPGRATEANE

SEQ ID NO: 43845 - protein, 121 aa, A.fumigatus
IIFMFCGLLTVAYSLLIFIFMPDSPMEAKCLSDREKVIAVERLRANQMGIISREWRWDHVRETFYDLKTWCWFFLIVSISYVVPARVDLRLALTYAESQAEASVRRATCLHYEPAGPNYGR

SEQ ID NO: 43846 - protein, 76 aa, A.fumigatus
  UNSURE (74): Identity of amino acid sequences at the above locations are unknown.
PCRYLIGQGIGSIVFPPYSEAFGRKKLYIVSTAMYSLSCIIIAIVPSVAGVVVGRLLSGFLSAIPTNVVAGRIXDF

SEQ ID NO: 43847 - protein, 61 aa, A.fumigatus
  UNSURE (58): Identity of amino acid sequences at the above locations are unknown.
ATAAATILPILSVSAMIIAAYQMGFFYNIKKSCNSNMRIGLPNHVRPRNTILLPPTTXPRP

SEQ ID NO: 43848 - protein, 93 aa, A.fumigatus
IGPYRVQSGGPDPRRRCVAAGATGQETLGRLGAGFFFLDFVVGLRELHLIVECVYDRDDARQRSSALQVMRALIQDAAAQGYGEYRTQMDCRG

SEQ ID NO: 43849 - protein, 136 aa, A.fumigatus
  UNSURE (115): Identity of amino acid sequences at the above locations are unknown.
NLSSHTMDPINPDLVNCPFMASSYSSLNFDGPLRVDANHAMNPQYAPNSFVHKFRPDTAEAPYQLADNTVSRKSHFYHEGKLSEYDQPRALYQKVMDARGREHLHCNTARMLKVXEYPEIQLRYLTQLYCIAPEYA

SEQ ID NO: 43850 - protein, 90 aa, A.fumigatus
RSGSPAHLILQVELNFRCHTKLSLACKNSLQLYTAAVGNNWKRSISMDYWRDFCLQACGYSEKLSYDCRPREISVSKYRLLSGHFCSTPA

SEQ ID NO: 43851 - protein, 217 aa, A.fumigatus
  UNSURE (19),(27),(78): Identity of amino acid sequences at the above locations are unknown.
YCPRSLSVPSAGDVQLPFXESSGSPKXDSAPSQSATTIPIPVSKRKASFSAPTRRVTVEEARAPSQPRAHHETNTERXPANFEANGPERHGGIVQSIEDPQNLVSRNDTSTPAAGSQHLPPVESATEIRPSKRVKLTQESSKTSTRPTPSPSHVITPPPIQPPTVDETMEVTDGAESQPNADQTRRASKSRGRRASRTSNVEDAAGKAKRKQQRSRK

SEQ ID NO: 43852 - protein, 80 aa, A.fumigatus
RRRCSPRFLSINASWTHSTMVSPKSSSHPSSKIDVINHSLIVIKLVFYLRPHPGNLQPKLTFIHLVPLFSHKQCSTVPQH

SEQ ID NO: 43853 - protein, 120 aa, A.fumigatus
DGTKVVGAGADKAARMLDLAANATTPAQVAAHDAPIRCCHMIPNPAGNSPLLVTGSWDKTIKYWDLRQSTPIATVECQERVYTMDVKNKLLVVGTADRYIDIINLDNPTKFYKTIQSPLK

SEQ ID NO: 43854 - protein, 218 aa, A.fumigatus
  UNSURE (203): Identity of amino acid sequences at the above locations are unknown.
SSQRSEDFAIQAAAILDTFAAYMHRNFDVTWKIRGVTRSCTVAKMDSINLTCVPGRKYWFKYWLKRAVLLSDIDLEDRLMVLSPRPTHNQRGPLLTPSSSSPSFDSTTPGASDDDDYYFPPGPAFTPSVRNARRVRESALRMVDVNEYLNDTPVALRENHRVSRPPECRDWSGYLGFVGYSQDHKHLASIMLGMCGVWNPKAXGMWDEKHARRSVYWL

SEQ ID NO: 43855 - protein, 166 aa, A.fumigatus
ERLSFQRRVKTATIGTTSGTYGSSNTYESTSNTYGSSNTYENRSNTAGPHGSNIANKLDPRVGSDADNRGLGTGTGTTSGTGAFGSGTGTGTGTTGYGTTSSNVGPHDSNIGNKLDPRVDSDQDNRARRQAMAGSSYTGAGTGTGTGATAGPHSSNIANKLDPRVD

SEQ ID NO: 43856 - protein, 152 aa, A.fumigatus
VPLVVPMVAATPTNPLATPTDLATLMKTEATLLVLTDPTLPTSSTHGLAPTRTTVAWVLALALPVALAPSAPELELELERQATAPLPQTLDPTTPISATSSTLVWTATRTTALVARLWLAAATLALVLAPALELRLVLIAPTSRTSSTLVSI

SEQ ID NO: 43857 - protein, 99 aa, A.fumigatus
WPEAFSLFYANTLSLSLPFQVSRLATTLLIRVLLTELHAAVENVTMEHCLKFHVLCKDALIIRRKPPLAGLHTAILDLLTNRRRPCSDSTTPGLEDIAL

SEQ ID NO: 43858 - protein, 108 aa, A.fumigatus
  UNSURE (104): Identity of amino acid sequences at the above locations are unknown.
MTGTGCFRSWSEMTPILLLQIFGWRIGWTSMYKYIEDVVMACSMARTDTPFILSSQGWPCRNGEVRVASDLKSFVLDSFYSFSRLALIFKLLPTLSSHTQLAGXTRSG

SEQ ID NO: 43859 - protein, 167 aa, A.fumigatus
RCSFQPRGEDQDQDLTALEDILKWKGFFRPNVLGLLLVAEFFPKWHKILYIWLTNDPNFEEVGEWFTWWRTQIPAEINELAVVDDEWNKGLQQMDLASRLDDPATELPVPNAAAQPAPPEDVPHAASEAPAPSRKPNVVEEIAFKDILESWCMEQGLIILPLREAHP

SEQ ID NO: 43860 - protein, 262 aa, A.fumigatus
KAKWVAEQLVLEAGRRGLPVKIHRAGTISGHSVTGAANAWDLLSALIVESIKLGYAPDVDGWRAEMTPVDFVSKAIVHLATQTQAGQTIFHLGDPDPVDTRRVFDALSELGYPTKRLGWDEWVALWTEKQRSVKGGDGAFTVDILRSGMPTVEFLRGIVVLDNAATNPFRAVVEWSRVDRALLETYTRHWFARGWLPKAPARLANPVVAIRGPLNRRVAVIHRGSSGYWRPLWATAPPSAKGMPCFPWPVRPSGYSLEFPFI

SEQ ID NO: 43861 - protein, 62 aa, A.fumigatus
SLILPAAGENIWGLPAATMEILKLNNGHLRVMSLCHNALQIMAGRIVLYVTFLVRLLASLAP

SEQ ID NO: 43862 - protein, 108 aa, A.fumigatus
AAHQDALASPMGVYFRVGLDAGTKLGHSLGGLLTMQDLDAGYGERTLTWGGGMTLFWFIDRKNGLCSVCAIQASLPFNTDAVMALRQTFRHDIYRKYAAFKAQERQGV

SEQ ID NO: 43863 - protein, 92 aa, A.fumigatus
RRGTLARKITVDPNMTLEEFIESLGERAEAQLKKPSMRTEEKTLYQRFPPQLEEQTRSNLKLKLKELVENGQEIAVSDPAYSIDFRFQLIFK

SEQ ID NO: 43864 - protein, 65 aa, A.fumigatus
SFARRIRTKTMLASTLGPSRTPTYTLVTRPQRFAPCILFMSKITSLLPGNVSSAYIHAVAGAFAR

SEQ ID NO: 43865 - protein, 102 aa, A.fumigatus
SKMNRFMGALSNSGRRSANYVGFYKGIQSCGAAIVNNLDARKLSYEKEFISNWVLLSVSLVVAAPVIFFKIRDHIDVQDDLAGTDETIADVLPANHPEKAVA

SEQ ID NO: 43866 - protein, 144 aa, A.fumigatus
SMVWFKLRFHNAANMAHMVSFDNGRTLKQKADFANSKCLGGLFSWALDLGGPGSLANPNDLSYDDTSMEGANAGGGTDGTGLFYVGPGDLRRKSKHRDCCGPRSTSSFRNSFSDPRQPLISALGFPTSLEVPTSTTTYRSYAGT

SEQ ID NO: 43867 - protein, 167 aa, A.fumigatus
  UNSURE (3): Identity of amino acid sequences at the above locations are unknown.
NIXACRASRMNMCAGLDLLWRNNIDPAKVLLGLGFYGRSFTLEDSSCNTPGCAFSTTSGSGGARAGECTGTSGILSDYEISRIIDDYSVNVHYDEAAGVNWMTWSGDQWYGLNYDFTTPLTWHIWSLLTMAEHSSRRPISRIANALAAFSVGRLILEALALWPILTI

SEQ ID NO: 43868 - protein, 65 aa, A.fumigatus
  UNSURE (22): Identity of amino acid sequences at the above locations are unknown.
KIKIKWKITVRTFRPRNLTLFXTRYILILPLILLLWTHYLAFFFIIILSSCLLSLFSSTFYLSTI

SEQ ID NO: 43869 - protein, 150 aa, A.fumigatus
KQICILSTPPPPTPSYAMNLSHVYEMLSSQITFNPITPIHDATRSTQVDRQSPRSNLSDTPPLKSPIPRGSPPPPPSLVLVRRRPPPPPKPYPSRVPHPFDPYPSRPLCHPPSQGPGLLLGPCPLSPPINHQGRPLPTQRKSIRVSAFTS

SEQ ID NO: 43870 - protein, 138 aa, A.fumigatus
  UNSURE (1): Identity of amino acid sequences at the above locations are unknown.
XISSQKPGYKHAGYDVDHPIIPHGVSVAVTAPAVFRFTAASNPDRHLAAAEAFGVDISNVKRESAGEVLGEALAKFLADLGDQPRGLNDLGFKHSDIESLVEGTIPQKRVLMLAPNLSGELERERDELRGLLEQSMEY

SEQ ID NO: 43871 - protein, 168 aa, A.fumigatus
LRLSGPGLKPEPERRDTPVPLNSKTSTPTPNDPTPEEPSNSNVASWSPQDVVMWMLQLGFEESIVEKFFINDISGAILLELEANDLKELDIQSFGKRHHLMNCIRQLKSSASMPGGDIQVTWDPSSREDNSTPKTTAADVGTNCCTSPVTDEERPDSGNKQHKHRRRR

SEQ ID NO: 43872 - protein, 115 aa, A.fumigatus
ILTAKYLPLDVNIGIGFFASPLTNLTVNQSQLKTGDYPQQISQPPMSPASQGESSLSRRSCIRCNQRKVGCDRKQPCSRCLKAGAECIHSGNKRAPRKLKRPPISKILVHLQELE

SEQ ID NO: 43873 - protein, 61 aa, A.fumigatus
  UNSURE (38): Identity of amino acid sequences at the above locations are unknown.
LCSETLVSPIALARLSMSEMAAAMLVAASAQEAPTARXQARFFSNISEADCVRPKDSSKGY

SEQ ID NO: 43874 - protein, 104 aa, A.fumigatus
YLAVGASCALAATNIAAAISDMDNLARAIGDTRVSLQSYQGGAFGAINTASAVNNAKLAARAARENLAASGAFTPDEAAQYYEAYMKMTPVLLDALTVAKDKVR

SEQ ID NO: 43875 - protein, 255 aa, A.fumigatus
RALSAGSAGPVVEDKGQRAEEVRQSGGSQISVRECATAGWHQIKVVCKRTNIVFWRSRNYGFTRLFNHVVIALVTGLAFLNLDDSRASLQYRIFVIFNVTVLPAIILQQVEPRFEFSRLVFFRESACKSYSQFAFALSMVIAELPYSILCAVCFFLPLYYIPGFQAAPSRAGYQFLMVLITELFSVTLGQMISALTPNSFIASQINPPIVIIFSLFCGVAILRPQMPGFWRAWLYQLDPFTRLISGMVTTKLPGR

SEQ ID NO: 43876 - protein, 135 aa, A.fumigatus
SRPWHSVVKSLSNNQLIMVLMENCSINKIPDIFFVAFGEVEHSLGISLRGLPQALSLWVLSNAFKYSSYSTCKFLNALFSLLRSRFQSCSRAGTYPQSQLAQIQLDSNPKAKTTTVTYKANSARQSQLEDSQCTG

SEQ ID NO: 43877 - protein, 101 aa, A.fumigatus
LALWIGPGTRARLESTPEQTEERIQKLAGAVRTIFECIGEDPEREGLRETPERYAKAMLYFTKGYEENVRDLVNGAVFHEDHDELVIAKAFHHGVPGPRLC

SEQ ID NO: 43878 - protein, 181 aa, A.fumigatus
  UNSURE (5),(103): Identity of amino acid sequences at the above locations are unknown.
SALLXRPSRRLRYPGHEYGRGAEARGEGAAARGGHCLCAGWGGWRAYGRHPFSVLVPAVVDVAKRYKSPMTGQPALVVAAGGINDGRSLAASLMLGASGVWVXTRFVASEESGASRMHKEAVVRALYGETHRTLVVSGRPLRMLPNDYIKDWEKRPQEIADLTAKGIVPMMHDLENEKEVD

SEQ ID NO: 43879 - protein, 180 aa, A.fumigatus
  UNSURE (76): Identity of amino acid sequences at the above locations are unknown.
PPGGPPLLSAVGDVGGFYHADLDKAPAQSFHNPTYGTTNGIDNAGNKPSNLVRSGASDTLPTIAMFTDFGKTWSAXYAASSTTHTGQVALSADADTVLLMNSNGAMVSKYSSTFSAVSSLPSGAAIASDKSNNTVFYGGSAGSFYESTDGATSFTKTASLGSSTAVKAISVNSRDKRKRA

SEQ ID NO: 43880 - protein, 113 aa, A.fumigatus
RSAVRHSFQILPLRRRTCDIRPDIPTPRIIGTLCSVADIIRSCLGPKAMLKMLLDPMGGIVLTNDGHAILREIEVSHPAAKSMIELSRTQDEEVGDGTTTVIILGILYCRSFT

SEQ ID NO: 43881 - protein, 149 aa, A.fumigatus
HSSAGEILAQALPQLERNIHPVVIIQAFKRALADALAIVEEVSLPVDIDDDKAMYTLIQSSIGTKFVSRWSELMCSLALKAVRTVSFDAGGGKREVDIKRYARIEKIPGGQIEDSEVIDGVMINKDITHPKMRRRILFTTRRQEPRLGS

SEQ ID NO: 43882 - protein, 64 aa, A.fumigatus
SNNLSRHVKASTSNALQRTFFPSNQYSLYTIEPFMLLFNFAELQSYSSEWLLSLRSRGTPPNDL

SEQ ID NO: 43883 - protein, 147 aa, A.fumigatus
  UNSURE (144): Identity of amino acid sequences at the above locations are unknown.
QRRLHRWGPSWRLPSIICGDCADTDSHSPACSPSVAVGNGGGFSGVSSTPINNHLQGTVRTESTSGIGIATFLIFIRSIFRTAELNGGFSSDLANDEVAFMILEGASMVIACGGMSIFHPGMSLKGHWKDPTPSTHWGLDRLPXISE

SEQ ID NO: 43884 - protein, 171 aa, A.fumigatus
SRRVPANASCFNQIRSIFRHSSIKYRCSSPINLARVDVNGARYFICLTIGPAFITAAIYLCFGRVIILYGEGFSRIKSRTYAIIFVTCDLICLILQAAGGAVIATAGRDQDGLRHTGINIMITGLAAQVASLGAFMALALDYLWRLRRHRQSQSCVFSVGGCWQWRGFLWG

SEQ ID NO: 43885 - protein, 71 aa, A.fumigatus
  UNSURE (70): Identity of amino acid sequences at the above locations are unknown.
SGQTGLASPPHLFFKAEKHEITKAMDSTDSSWEMPFVINIWSVQLSWGDCRAAPPFSVWSWRGKNRGLIXR

SEQ ID NO: 43886 - protein, 152 aa, A.fumigatus
  UNSURE (3): Identity of amino acid sequences at the above locations are unknown.
SDXPSCRLVKIAPRCPIVIQLLMTAAGALNMSRALGDLQYKAPLINADEPFSLEQEIAGFNPDKEQGDLLSNRPAISRIELKEDRKYIVILTTDGVTDEMEDRRILDQVVAHWNYGTRAEGVAGKITTEATGGPMSDNATCICAFIYGRQAA

SEQ ID NO: 43887 - protein, 78 aa, A.fumigatus
CNLYMCFYLWETGSMIGLIMAWRIIPYDVFSSSQTMDMGSEYTPASYCTSSGYPYIKLFLPMKSMQQSYVCYQLRSGE

SEQ ID NO: 43888 - protein, 65 aa, A.fumigatus
  UNSURE (11),(12),(13): Identity of amino acid sequences at the above locations are unknown.
IHFLAPGFLLXXXWIVLPKVDDSSDLSLEDDRAYSAPVKTGSGPAGSARVVEHTSLGGAIMKASD

SEQ ID NO: 43889 - protein, 207 aa, A.fumigatus
VSPQLIISPNGTSGINFRGKMAHHQQGNLGGGFSLFTGNCSGAEACIGIGAACARQWPQKGFHLALTYSTNLEARNMLVKELRSSQPAADGADALRISIHQVDVASADQIQTMFAQIDKEHGQRPDILVSNAGYGKRIPQVWDISLEAFDYTINVNLRASFILVKGVVDHMREQRWGRIVFMSSIAGYGGGINGCRKCMNLYPRPEA

SEQ ID NO: 43890 - protein, 61 aa, A.fumigatus
LADAYQIDYAASKGGMTGMMKNLATRLAEYNISVNDVAPAMIGDTGMIPSAPVFTTSSRTA

SEQ ID NO: 43891 - protein, 72 aa, A.fumigatus
HPTNMQRIVAHPQCYLSFGDLFHFLSHSAPNPDFFLTHLVGYQIKYLEHCPLHPGPGILEGQMTYKIIDSRL

SEQ ID NO: 43892 - protein, 167 aa, A.fumigatus
LFHSTPLHHNYTVSLVNHVIQYEQYGHPVLKNIIHPSRTLVAIWIGINDINDSAKYAVHFPTLYNRMMTTLFTSVHTLYNLGYRSYLFMNLPPLDRTPANQARSNPSPNATQITWFNNALSQHAMSFARTHPNATGQVFDAHTALSNRNGHPAQYGIPQHERISAQV

SEQ ID NO: 43893 - protein, 250 aa, A.fumigatus
  UNSURE (1): Identity of amino acid sequences at the above locations are unknown.
XFFAGEYKVPLYLQSVKEASPMRYGVFVLPVVLSEAFAGIITGALIHRTGRYRELIWLGMTLLTIGNGLYIHLDAYSSLGRIIGYQFLSGIGAGFLFEPPIIAIQAMVSQDETATATATVGFIRNLATSASIVIGGVVFQNSMRRMKPTLLAAGMSETLTEQMSGDSAAANIEMIKTIEDATQLLAVKEAFASSLRNMWILYTCMSALGIVAGVFILKTRLNKEHVATRTGLIFVPRGDKIRAMYRDPQK

SEQ ID NO: 43894 - protein, 216 aa, A.fumigatus
  UNSURE (6),(7),(9),(13),(36): Identity of amino acid sequences at the above locations are unknown.
SCHSQXXEXLLEXNESLHIPADQRLNLSAPGDSSYXPTPERSPMYVDTATAKSILKDAKAQMAAGSMTLEAYRTLGDDIKRGNAFAPRMHYTALQKVPHTAVPPLREDSSTNISLEEKLGYLTPEHETEYYLSMDAKLGDEAAALELSRIPEKPSFAERERELALRNPVSVYNWLRRNQPHIFLQDHENASEKSGSRPTNARASKRSSPRGWKFRV

SEQ ID NO: 43895 - protein, 141 aa, A.fumigatus
  UNSURE (136): Identity of amino acid sequences at the above locations are unknown.
RIVFANSFESVKQLWIKDQSALISRPTFHTFHSVVSSSQGFTIGTSPWDESCKRRRKAAATALNRPAVQSYMPIIDLESTASIKELLKDCRNGAVDINPTAYFQRFALNTSLTLNYGFRIEGNVDDALLRETVDVXLLASG

SEQ ID NO: 43896 - protein, 123 aa, A.fumigatus
  UNSURE (7),(13),(14),(20): Identity of amino acid sequences at the above locations are unknown.
RRSHRVXYSQLIXXIIASFXRTDLIDRRNYFMAQTIVLAVFAAVYLLIRYLNRTDIPKIKGLPEIPGVPIFGNLLQLGTEHATVAARWAKKYGPVFQVRMGNKVRNFVPGLGLSCHHLRGGGF

SEQ ID NO: 43897 - protein, 82 aa, A.fumigatus
  UNSURE (20),(23),(24): Identity of amino acid sequences at the above locations are unknown.
FADMFGLNVLRAEENFSFGXASXXQKLKSTLNETNLFSAEGNPVNVPSSGYCSTNRINPYWKKFRFSRKQEPESFEPLPKLV

SEQ ID NO: 43898 - protein, 172 aa, A.fumigatus
HEDVVERLKREASNLARLRHPSILQVLEPVEETRGGGLMFVTEPITTSLASLLREKDEQERTSRIGSSSSHFMVEEADGTRRRRDLEIDELEIQKGLLQVAKGLEFLHESAGLVHGNLNPEAIYINSKSDWKISGLGFAGPPNSTESRSSLPPLALSEVLYHDPRLPQWSPS

SEQ ID NO: 43899 - protein, 148 aa, A.fumigatus
  UNSURE (7): Identity of amino acid sequences at the above locations are unknown.
CPARLVXNAPISRWRVYKNPNKLNESMDHVRKTLKWKAFLIGRFLFPGISPRYIYLTAKGLTVATLAIFVRSVFRVAELQEGFDGPLANDEVTFMILEGAMMAMATLCLTVLHPGYCFGGYWDQTSWRSIKQSSQLSLMELKAQNSRA

SEQ ID NO: 43900 - protein, 160 aa, A.fumigatus
RCPGRSAGEDGAGNATHSDLFTTASASHIRVVLKDDTLGLGARPKRDLLDGPTGLDAFKGLLGRLNGKSDTQLEAEQQKRDDAKLARYAATKWQTVRFISGGLLVQEKDNATASPASQDLRVDFPRETSSNEHENGMFKTEPMDSYSHQEGCATAREEEG

SEQ ID NO: 43901 - protein, 70 aa, A.fumigatus
GWRSFDVDGPFEASRDVPLSFATATRTFVEVLSAVSVSSLSQSPIFLFFGIFSCFFSRDFLGLMSISFPF

SEQ ID NO: 43902 - protein, 108 aa, A.fumigatus
  UNSURE (12),(28),(108): Identity of amino acid sequences at the above locations are unknown.
KMVPRSFQFAGXKDGRGVTVQRACVSRXFADRFAKLNSALRNSAVGDYEYCRHGLELGDLKGNEFVITLRECIIPGVDLQNPEDAVATAKEFVGSALRNLRERGYFNX

SEQ ID NO: 43903 - protein, 148 aa, A.fumigatus
YGLQRFGTFATRTDMVGVKMLQGDFKGACDAILHYSPHILAAAQEGNSSSMISSDDKARAEAIHIFQTTGKVSEAVEKLPRKFSAENNLIRHLGRSQNDYLGALQTIPRNLRLMYVHAYQSLVWNFAVGERWRLYVSPPGGKDRRLGI

SEQ ID NO: 43904 - protein, 79 aa, A.fumigatus
ERDGPGYFYSRSIPSISYFSSVVIIGVGAAGPRQVSSPQKENAEVMTLIAAFNTPPKKQLGFRTDTADPAWRDDDDNDD

SEQ ID NO: 43905 - protein, 149 aa, A.fumigatus
HTALIMTLSGCVVVVAGASKGIGRAIVLRAAADGASVVINYMSDVKGANALVAQIGSDRAIAVRADISKTAEVDELIEATVARFGRIDVLVPNAAYVPESNLRSVTEEDFDRAFAVNVKGPCFLAKAGAPRISLEFGTHAEILPSSQIA

SEQ ID NO: 43906 - protein, 279 aa, A.fumigatus
  UNSURE (1),(2),(3),(12),(13),(14),(16),(17),(18),(19),(20),(21),(22),(23),(24),(27),(64),(80),(204): Identity of amino acid sequences at the above locations are unknown.
XXXKKKKKKKKXXXKXXXXXXXXXFLXLSLSLPLSTVRVRQFTIGCVFSSDDYGHRCLGRIPSXQRQLQFDRCPRSHHFXQVLCSHPPLPLPLPRKSKALHTFERTQVPIYQHNSFLFSVISGTTSIIGATETTTLSLDPIIWGSSTYSPPVETRSLGGSTTVIGGTTLPPTPITVTPNPHPTTTPDPGSTDPALNSKKPSWTXGKPPTPTAEPGCPGCGTRCESLCFLCCLGHVKRPWRLTQLSPHLGLLFCNPDCPFCPPGHLSSLSRRHGNLTPPP

SEQ ID NO: 43907 - protein, 83 aa, A.fumigatus
  UNSURE (27),(43): Identity of amino acid sequences at the above locations are unknown.
GYASSLLDASFPVTTTAIDVWGVSLLXSASSSLTGAPVPIILXKFCAATPLYRYRYPVSRKPCILLRGPKFLFTNTTHFSSAS

SEQ ID NO: 43908 - protein, 142 aa, A.fumigatus
HLVEYIQLDQMRMEKQNIPSAARSKVNIRFRNYATDVDEAKRKLKSLSDDRKALFGDRYTDEPQDEHLEQRQQLLSGTERLERSSARLQESQRIALETEDIGRNTLADLYQQRQTIEHARAGLQQSEGYVDLHHTAEGPCKR

SEQ ID NO: 43909 - protein, 61 aa, A.fumigatus
  UNSURE (13),(14),(27): Identity of amino acid sequences at the above locations are unknown.
AVRCQTVIFQEIXXLCFSELYLSKLDXKQKAFHFLGKHILFSSEPRKTPKRMKGFFSEQEF

SEQ ID NO: 43910 - protein, 169 aa, A.fumigatus
GGADPSTPSCKNSPHVHMLDIECFTYLNRALESSISPIVILASNRGHTVIRGTDDITAAHGIPPDLLARLLIIPTHPYTPDEIKTIIRLRAKTEGLNITDPALDKVADHGSKVSLRYALQLLTPASILARVNGRPGGIEEADIAECEDLFLDAKRSAAIVSQDSEKFLS

SEQ ID NO: 43911 - protein, 138 aa, A.fumigatus
  UNSURE (133),(136): Identity of amino acid sequences at the above locations are unknown.
GKTRRWIEHNANAALLTRNNDGKFGTWWGRRYRVLDDAIIDQSPLPPGAVDYKNYDNRGDGWSKEQTGALRGRASWTASSAGTPESSDQRTGSRETWIWTNRPTLAEVRLMDYNDRGRGRTVETQSGGIAVLXPGXPP

SEQ ID NO: 43912 - protein, 143 aa, A.fumigatus
  UNSURE (139),(140): Identity of amino acid sequences at the above locations are unknown.
PRDPGSLVVKTVDDDVKSALEGLQDGGLVQLVRSLECGAEFGSLKDFIISLIVNYEFCEIQAIDIPSETFKLAAAESGIDANSVQTHISSSSPRYTFYHYPETDTVFFIYTCPSGSSIKERMLYASSRMYALRVADEQXXGGG

SEQ ID NO: 43913 - protein, 141 aa, A.fumigatus
  UNSURE (1): Identity of amino acid sequences at the above locations are unknown.
XLKANNTSFTMSVWNPDNIRDVAESVGIVNLSNDVTENLARDVEYRIAQVLEEALKFMRHSRRTLLTTQDVAQALRVLDVEPLYGYETTRPLRFGEASLGPGQPLFYVEDEEVDFEKLINAPLPKVPREISFTGWCYSCRF

SEQ ID NO: 43914 - protein, 103 aa, A.fumigatus
LMRHCPRCRGRFLLLVGATAVVFRSVFCADWFYCTAHWLAVEGVQPSIPQNPTAADSRNLELTAKGPNANSTLAAMSGTGDVAVNPLVSLHHRGRKVRSNAFR

SEQ ID NO: 43915 - protein, 85 aa, A.fumigatus
INRSFLIQRLKVGTELIIRLKWGQTEYKGKLESIDSYMNVLLRDTEEFIDGKNTGTLGLVLIRYVSDCGVPITFAEHVLTDTNQV

SEQ ID NO: 43916 - protein, 167 aa, A.fumigatus
KQHLSEPVAPQLRERPVSRVPELSYSSIRSVETLPVGATSPVAVVSGLQIADENMHPAHLRDAVQDKRPTDSMSIAKDIPSDDAAADAEDLKSGAALPLGTISGNAVTRGRRRQSNQADSGAQTILSSKQIDQILMERVSSRPLSPPDSDKAKEAGPSPFATPKARP

SEQ ID NO: 43917 - protein, 181 aa, A.fumigatus
  UNSURE (8),(171): Identity of amino acid sequences at the above locations are unknown.
PSVSCAIXSPSPVNTPPHHGSDIVSPNTATRGEMYPQQPQAQNPDRAAHLLNLLKFNQGAAAAPSQQQPTAVGMEQPRSPLTQETGFEGVFRSHTRNISASDLVASLFGRQAQAPPSAATPPMMPNPSQFAQPGHSGVGESSLSAAPTAEHTQEMLLRLLNRPSPSQDVPXAHEAARSALG

SEQ ID NO: 43918 - protein, 108 aa, A.fumigatus
EKLAAVDRCKRELLQVYDVLEIRLSGRYGGGTREYLAGQGQGKYSIADINAWAWVRNIRRIGLSENELAPLPHLQQWVDRIAARPAVERGLGEWYDEDVHPDLLLETA

SEQ ID NO: 43919 - protein, 134 aa, A.fumigatus
  UNSURE (129),(131),(132),(133): Identity of amino acid sequences at the above locations are unknown.
RQEDKQEKVEAPKQDLGASLFGTTSLTSSVSANPNPFSSNTSSGFPSNPFAAPTAAPTPAKETSTTTQSTTTLSETFADKVRVSSPPPETMPPEAAGPAAPWPEKSAFPAPYPQFYLDAEYETLSRPPXYXXXP

SEQ ID NO: 43920 - protein, 76 aa, A.fumigatus
  UNSURE (64),(65),(67): Identity of amino acid sequences at the above locations are unknown.
FMGIIWLKLSQDSSGTIDRDEFLSLPQVSSNPLATRYVRQAIDGGTVEEHQDVGDKLTVAEQDXXFXSDDGPYRRK

SEQ ID NO: 43921 - protein, 209 aa, A.fumigatus
TDSSWSWRIPSVLQCVFSLIQAVLSLLAPESPRWLIYHGRREEALAMLAKYHADGDTSSRLVRFEMAEITATLEMEKIQRASRWTEWVATRGNRHRLFLALYIPAMLQWAGNGLTSYYLSKVLNTINVTDPHVQLIINACLSVWSFLTAAFFATLVDRAGRRRLFLGGMGGMGVSYVIWTVCSALNEEHHFQDKGYGLHRGAGRTAPTG

SEQ ID NO: 43922 - protein, 152 aa, A.fumigatus
SRGEETVHNQEPGELPSHDAPAPDMDPEDQGWIREFAKFKKDTKVKAAPTAPPSIVPSEHRSTLASTMFTVGGTPIRRKKRKGALTNPSAYSMTSSALARTEGHRLLDDRFDTIEALYALDEDGEEYDDNMSMVSGMTGMTGISTASSQAPS

SEQ ID NO: 43923 - protein, 129 aa, A.fumigatus
TARVQKRDLFNAFRAHSSAFDGTPLGQHLRRSSPPPDFLAQIMPALAEVVNRASDAVGALNSAAEELSSMGFSGTTVNDIISEMRHRFRSARLGLKRALPGETANVGLEDGSATLAALVNRVKLLVKDL

SEQ ID NO: 43924 - protein, 129 aa, A.fumigatus
IRELQEICDRSSDEESVTDATSTNIGPISKLSVGILGTHQSAGSDTSGSQYLQRLQVQALWHVYRENVAPMIAILHTPSIEAMLREGYANKDSILQPEQEALILAICFAAVVSMTPQQCLSILGGGHDA

SEQ ID NO: 43925 - protein, 74 aa, A.fumigatus
CVPRIPTESLDMGPILVLVASVTLSSSEDLSQISCNSRIYPLSATQNLYGNNTHTLSPRLTVFTYGGRTAPHVR

SEQ ID NO: 43926 - protein, 122 aa, A.fumigatus
LNRKEQDRLIGYAVGHITSGLPRWMYVFIIFGAVSVATGIISLLLLPDLPSTARFLNPRERAIAVDRVSRNQQGVKNHHFKWEQVWQAARDPKTWLLFVMAVGAQVPNSALTSVCFTSMLHC

SEQ ID NO: 43927 - protein, 72 aa, A.fumigatus
RWIFQAPWVKTAGELGCSAGDDKCLCSQANYGYGIRDCTTEACPDDDAIAVLSSALSSCPSKHSHSALPQCD

SEQ ID NO: 43928 - protein, 95 aa, A.fumigatus
LQSLGDSAAVTATGAGGSSSGSGSGSDSGSGSGSGSGSGSGSGSGSGSSSGSGSGSGSGSGSGSGSNSGSGSASSTATGTATGSENSTTGGAGAG

SEQ ID NO: 43929 - protein, 141 aa, A.fumigatus
PAPAPPVVLFSLPVAVPVAVEEAEPEPELEPEPEPEPEPEPEPEPELEPEPEPEPEPEPEPEPEPEPESEPEPEPELEPPAPVAVTAAESPNDCNQHPAQSHWGSAEWECLLGQEERALERTAMASSSGQASVVQSRIPYP

SEQ ID NO: 43930 - protein, 102 aa, A.fumigatus
FEERGCRQGMSRIHIQVYAPDHVWQRANHYQRQLRDLGIMVVQDARICRHLAAPSILRTPKFVNALAYGPAIVNIEFITECLKKNELLNPDDFPLVDKSAEK

SEQ ID NO: 43931 - protein, 219 aa, A.fumigatus
  UNSURE (1),(2),(3),(4),(5),(6),(7),(8),(9): Identity of amino acid sequences at the above locations are unknown.
XXXXXXXXXKTSAPEPPSKKALRKAKKKVAEPTTDPTTKQEAAVPSKKQEDEAPKKRSDHGIWIGNLAFSVTKDDLRKFLTSNCTFADTTITRIHLPKGQEKFGKAQNKGFAYIDLANEKAVKEAVGLSEQLLSGRRVLIKDAKNFDGRPKKSESDSAATVTKPPSKRIFVGNLGFDVTKEVLEEHFGQCGTVAHVHVATFQDSGKCKGYAWVEFEDLA

SEQ ID NO: 43932 - protein, 66 aa, A.fumigatus
SKILELHPSIALAFSTILKRCHMYMCDGTALSKMFLKNLFCNIKAEIANEYPFRRRFRNCCRGIRL

SEQ ID NO: 43933 - protein, 203 aa, A.fumigatus
RQLVIPVASPTPSTVTSEAVTTLHSTSTTTVTVIASASTPAASPSPATDKVPLPTPAITNFPSTGVYTIPATTVTVFETTTVCGTTTTELPAGTHTYGGVTTVVETATTVVCPYATVEPSGTTVTSVIKTTTYVCPSAGTYTIAPNNTTVPTSNVIVYPTPAVITPGYYTQPEADCDRHPHRLTLCLPPSRPRTSPTSGPGCP

SEQ ID NO: 43934 - protein, 179 aa, A.fumigatus
SVRVTVTVCFRLSVVTRSDDGGSGVDNDVAGRDGGVVGSDGVGASRGADIGGGLDHAGHGGARGLDGGVGADNSGRGLNHSGDTTVGVSTSRQLGSGGSAHGGCFEDGHSGGGNGVDTSRGEVGDGRSGQRDLIGSRARAGRGSGGTGNNSHGGGAGRVQSGDSLGSDGAGSGRRNGDH

SEQ ID NO: 43935 - protein, 109 aa, A.fumigatus
  UNSURE (98): Identity of amino acid sequences at the above locations are unknown.
PRCVCVRPSLRVALRTDENQLQYHPVRNNILLSGSTDGLVNIYDTTITDEDDALVQVINHGSVHHAGFLGERTIYALSHDEDFSVHPATDPDEEPEEXSPQAPKSDERY

SEQ ID NO: 43936 - protein, 237 aa, A.fumigatus
LQGAQRISSQSIKRTMGELDLPGIMSNINLRMDANFDRDLHFKPDLDGEKGRRKRKEAGDYWEAMAAEIAIYAFCANQTEDTTNDDQQDDPPQTFEPRLPAMFETLQDVLKTLVPERDHPAVTQNLEVALLMQQVRKGVLDMVGIANWLARLLKTHCAPMRDEWADRMVEQIRAGSESQDSMEIVRGLQTLFAILEAMKLVGLAVVGSTHTQVYVLTLLLLGRGDVLTTWKKRPLDI

SEQ ID NO: 43937 - protein, 141 aa, A.fumigatus
KSLSRGCNSSPPSFTMASNPVNERGVFVHENTSAPEHPSLMQMFSLKGKTAIVTGAAAGIGLAVAQGLAEAGANVALWWGANSSCPERAAEIAAKYGVQCEYSSELALVPFRLDVKKWKSNFHSQGLPGRCYKPQGCPGGC

SEQ ID NO: 43938 - protein, 118 aa, A.fumigatus
RCTLTVRANNALEEESWLNPCHIKSRVGISLWADCGYKVLNTPVCSRPLIQCLWRHQKATKSTTRTYFSLTMRISVGALLGLTALSHATTEKRAASASAYCSNSAGNYKLSSIAAPVQ

SEQ ID NO: 43939 - protein, 168 aa, A.fumigatus
CLLPDWLKKIVTAAGMKTEVGRIAKLLQETSDDADSSRLVQAVRRVKSTAENVLGLAGTPLQVKLSKFALLLFALAVLLAIIVFSVNKWDIEGEVLIYGIAIGVAVIPESLIAVLTITMAVGTKAMAKGNVIVRKLQCLEAVGGVTNICSDKTGTLTQGRMIARTAWI

SEQ ID NO: 43940 - protein, 61 aa, A.fumigatus
MADEIALAVVRSVADNLTQQTNVNAAAIRHQKSEALVFLLLVFHCLCYHSTEYGAGFSTVK

SEQ ID NO: 43941 - protein, 78 aa, A.fumigatus
SFLSAYKDSPGVAWSRSGCRLMYGYQNTTTTPCAYTLNKYYLPFSPSGIDFLAPHIAVYIVVFHCSPGKFSIWRMAGL

SEQ ID NO: 43942 - protein, 61 aa, A.fumigatus
PFSAYNFGIPALPWINGRDLAGEVIQVSDGCSRLRVGDIVLVPSTDYRDMFSARGCRTALE

SEQ ID NO: 43943 - protein, 172 aa, A.fumigatus
  UNSURE (18): Identity of amino acid sequences at the above locations are unknown.
HFPTAAASTASPPATSTXGITLLNAALRNIGLFLPPWLHLILLKIPWLTRDWWAFQSFCSERLHARMRMDLPIPDISASLLAPLHGRAPTPEERLMLDGDARLIVVGGSDTTAVSLCGALYELARHPEQLRKLREEVEPFVDAAGDVRGADIALLEHLNGVINEALKMYPAV

SEQ ID NO: 43944 - protein, 182 aa, A.fumigatus
  UNSURE (156),(179): Identity of amino acid sequences at the above locations are unknown.
DTAGYIFRASLITPFRCSRSAISAPRTSPAASTNGSTSSRSLRSCSGCRASSYRAPHSDTAVVSLPPTTISRASPSSISLSSGVGALPCSGASSEALMSGIGRSMRMRAWSRSLQNDWKAHQSRVSQGILSRMRCSHGGRKRPMLRSAAFRRVIPXVLVAGGEAVEAAAVGKCHQPANXHPH

SEQ ID NO: 43945 - protein, 131 aa, A.fumigatus
YRSPQPIVLFSPQLCPWAPARDASVKMTSILSWFRRLYSLDTLDTRFTSSATTSLKAAADTRPPSAKDARANAIANGASPPNWRTPEFFVYYLVFLTVVPMMFKTVIDASKGTACGCESGGSLETPADHLL

SEQ ID NO: 43946 - protein, 165 aa, A.fumigatus
LWSVCRSGGEDLGALAGSSSPRTMRALRKIQSHQILSSKTSAFSGPTSHLSTARSSVNAEAQQAHLDSPVRLRHRRARSNSDAGSGERPILQAQKRSGRKTGSGFGIKRSVLETLLRDGPQNGDVEDALKELRYLVLSTRVEADGDGMVCGRCNSAVTSRRIMGL

SEQ ID NO: 43947 - protein, 105 aa, A.fumigatus
  UNSURE (87),(96): Identity of amino acid sequences at the above locations are unknown.
QDIKVFDEEITAKWRKEIIGSGEDITPNMMDWIIKEAQWKAKVFQDTKHVVAFDAGVVKSDIAIGEELRQVLKDAVRPLEDVPEGLXDYHPGSDDXVVDLGPSVP

SEQ ID NO: 43948 - protein, 64 aa, A.fumigatus
SIMPGGQYQKLLIATSAQASGRTPIYNFTSTVKGSKRFTWITRELLADMLGKEEREFGKARNSI

SEQ ID NO: 43949 - protein, 62 aa, A.fumigatus
  UNSURE (33),(55),(58): Identity of amino acid sequences at the above locations are unknown.
RRGLMFKYLHLIFSREFFLRPCQSKPNLFCSSXQHNFLDFQLPSKYHRHFLDSAXQPXNGIG

SEQ ID NO: 43950 - protein, 196 aa, A.fumigatus
  UNSURE (151),(155): Identity of amino acid sequences at the above locations are unknown.
KRGAQQSQSTGGGLFGSNAQQKPMFGTTPSAPSGGGLFGNAAKDKPAESTTPTTTADGAAKPLFGAAPSAPAGQAQGSSLFKMPSSSADSGSKPAFPSLGTTTTTTTSQPSTALTTSSDTPQKSLFPSLGGTTSATPSTTPAAAPAGGGLXGGLXASKPAETGAATTTTAPASQPAAATGGLFGKPAETTSSTQAP

SEQ ID NO: 43951 - protein, 97 aa, A.fumigatus
  UNSURE (64),(68): Identity of amino acid sequences at the above locations are unknown.
RRFRVETCFPVSRYNYHNHDQPTFYSLDHIIRHSAKVTIPQSWRYYVRDPVNYTSGRSSWRWSXWWTXCVQACGNRCGNNHHRSRFSTRSGDRRTVR

SEQ ID NO: 43952 - protein, 203 aa, A.fumigatus
  UNSURE (9): Identity of amino acid sequences at the above locations are unknown.
VVSGRGSFXPWSASCSDATRQAPPAPTGSSYPSGFDMTRSWANLSPYQEADSFGVPKGMPHGCELSQVHVLHRHAERYPTPYPLDGQGMEDFAAKWSNYTRSLHLKAPATGPLSFLNDWEYILGEDTLLATGAATEATAGASFWANYGRLLYRAGRENGAAWNASLNVYPNGTARPKPVFRTTSQPRILQSARWWLSMDSLVQ

SEQ ID NO: 43953 - protein, 150 aa, A.fumigatus
SRQLFVENSQDTDVLPVDYRKMADPIADAPVIDEFAQTRGGDDLFDDEIIPVSADEQVQAEVQTPEENVADTKSQEPPRIDTPPRSRGADRRGGRGRGRGRGGRGSHHSCRGRAYGGPRGMSTDNAAEREDNKVENAARDTPAEGSEQSA

SEQ ID NO: 43954 - protein, 72 aa, A.fumigatus
TCPSALHMHARDMNGATRVLRVLFLSLSLLVYPLHVSAAGYLSVVAPGSWCLQHFPPVSEPQLVLVRLRILG

SEQ ID NO: 43955 - protein, 70 aa, A.fumigatus
ARRGIYPWWLLALGVCNIFLRCLNLSLYLFVCGYWDDFVIEQIVPASSLRELVYDRRVGDGIGHFSVIHW

SEQ ID NO: 43956 - protein, 68 aa, A.fumigatus
RRTGRGQTWPFLTDPPIYSIIANTFIFSFLIAIVKWEVNLRQLTSRYVFSFCSTGTLTPLILNPSDKI

SEQ ID NO: 43957 - protein, 211 aa, A.fumigatus
  UNSURE (3),(7): Identity of amino acid sequences at the above locations are unknown.
RPXAIAXPSMPVVKIGMLRITPARVKSTSFTFALITRRSRHRGGTRYFSRGIDEHGHVSNYNETEQIVILNDAAGGLSGFAPGQSMAKDKSGGSGQDLQIMSFVQTRGSVPVYWAEVNNLKYIPKLQVRGVETAVDAARKHFSEQIRIYGENYMVNLVNQKGREERVKTAYEQLVRILVSSSIEDPEADENTSEKVHVVESGQKQKELDRL

SEQ ID NO: 43958 - protein, 150 aa, A.fumigatus
TRALRVVAIAAGRQLGSRLFGPPALKSAKLSYENIPTVVFAHPEVGTIGLTEPQARQRYGDDKVKVYYTKFTAMYYDVLPTEEKKKNPTEFKIVCVGPEEKVVGLHILGLGVGEMLQGFGVAIKMGATKKDFDSCVAIHPTSAEELVTMR

SEQ ID NO: 43959 - protein, 65 aa, A.fumigatus
RPSSQVPQAISEGRRLYVGNMPYTAKSEDVQALFTAANFPMYGDKNSCMEMAKTECFAASGSISR

SEQ ID NO: 43960 - protein, 122 aa, A.fumigatus
  UNSURE (119): Identity of amino acid sequences at the above locations are unknown.
VLCSERIDIAIDPFTGRNPSYCFVDLETRELANKAMTELDGRDMLGRPVKIKPGVAKTASERSQQQQHQQQRTESSPRSDKGRPFALDRWRRNDTPAFAKVDSVSSRRLYVGAHRPTSXKSV

SEQ ID NO: 43961 - protein, 72 aa, A.fumigatus
  UNSURE (54),(61),(71): Identity of amino acid sequences at the above locations are unknown.
RGFPYDLSQRHVMEAPNSLAVDAWDGSFTYAELNDLSHRLATHFDRDGVDPNVXRPVYFEXLAGRPLLCWXS

SEQ ID NO: 43962 - protein, 120 aa, A.fumigatus
  UNSURE (111): Identity of amino acid sequences at the above locations are unknown.
PGLIPAPANHPPSRQEQEATLHSRTRSRCPQPRRSNTYIECPNQRARQPSRYPQPRIRRSIQQEGINCRRRQGAPANRQDTHPSRRSPVRRTTPRPSRSGRAIPKRRRTEXFSPSAKNTR

SEQ ID NO: 43963 - protein, 145 aa, A.fumigatus
  UNSURE (133): Identity of amino acid sequences at the above locations are unknown.
NPPPRNLEVPISVGNTTMYQSSQGLSQLLQTILQADKSKKRRSILGPEAGAPSPAGQTHTSNAPTSARDSRADTPSHASAGPSSKKGSTAAAAKEPPQTVKTLTPAEEARYGVQHHDRLVPGVQFRSDGAQRXSRRAPRIRASAR

SEQ ID NO: 43964 - protein, 147 aa, A.fumigatus
  UNSURE (135): Identity of amino acid sequences at the above locations are unknown.
FKTLPQGTSKCPSVWAILPCTSLARAYPSSCKPSSKPTRARSDAPFSDPKPVPPAPQVKHIHRMPQPARATAEQIPPATHPPVHPARRDQLPPPPRSPRKPSRHSPQPKKPGTAYNTTTVSFRACNSEATAHRGXLAERQEYALALG

SEQ ID NO: 43965 - protein, 108 aa, A.fumigatus
  UNSURE (95),(96),(97),(98),(99),(100): Identity of amino acid sequences at the above locations are unknown.
EFNIGVWSRMKWPRAGLIPSPNHFFPGNWQANYPWALFSLKKPTCLNPGSPSFWCHARGSHVYLSRRFLGIVLTLIFFNFLFDPFMPFPSLFSLXXXXXXQKYISDLA

SEQ ID NO: 43966 - protein, 116 aa, A.fumigatus
  UNSURE (46): Identity of amino acid sequences at the above locations are unknown.
REYSGWYFKDYFNQPSRAAIGTVVAILEVGAFISSLIVGRIGDLIXTRKNILYGSVVFSIGGAFQTFATGLPMMMLGRIVAGLGVGALSTIVPVYQSEISVCKNPSISPAPILCRS

SEQ ID NO: 43967 - protein, 132 aa, A.fumigatus
FHSCLLFVFFFSPFYLFILSSLLLFSQTNPLLFLSLGGSLLWSCVCTLAKPIGPCSEPITCDSPAHKSASLNLSISRAPPLNIHHSDIPPIQSEHPSFCSTIDCSLPKTDFRTPFYAIFRHSLLKCSPPYSR

SEQ ID NO: 43968 - protein, 174 aa, A.fumigatus
SAGVTDPYEFYKYVHLSEVGNCIGSGIGGTHALRGMYKDRYLDKPLQKDILQESFINTMSAWVDMLLLSSTGPIKTPVGACATGVESVDIGYETMVEGKARVCFVGGFDDFQEEGSYEFANMKATSNAEDEFAHGRTPQEMSRPTTTTRAGFMESQGCGMQLILQPRRLKIMRP

SEQ ID NO: 43969 - protein, 94 aa, A.fumigatus
PIFSQTSYCPRFFVSSFYLFLLSPPHRLVYTRRFTLVPHLDTSIVFDFSSFPPTNVSITTFVPYSQVLLLFLRVSARGSRLLSVSYHQPYARFD

SEQ ID NO: 43970 - protein, 211 aa, A.fumigatus
DRGKTSLTDGLIATNGIISPKLAGKIRYLDSRPDEQLRGITMESSAISLYFSMMRRSSPDTPPQPREYLINLIDSPGHIDFSSEVSTASRLCDGALVLVDAVEGVCSQTVTVLRQTWVEQLKPILVINKIDRLVGELKMSPSEAYSHLSRLLEQVNAVIGSFYQGERMEEDLQWRERMEERINASAARTAQKQGQCDETNMSSVDEAEFED

SEQ ID NO: 43971 - protein, 63 aa, A.fumigatus
  UNSURE (11),(13),(36): Identity of amino acid sequences at the above locations are unknown.
NDEDIYFAPEXKXVIFCIAINGWGSIVPPPRAGLRXGNYVFKRLILEKSAMGENSNLNLKTKV

SEQ ID NO: 43972 - protein, 85 aa, A.fumigatus
RKIRLLWAVPPWWESPEVVIEATKERSLLHHNIHCIAYPEAIRIYTNGSGICGRVDTAAVCLGPPSAVNVTWGRSTDVEHTVPVA

SEQ ID NO: 43973 - protein, 74 aa, A.fumigatus
  UNSURE (8): Identity of amino acid sequences at the above locations are unknown.
TLLSGCPXYVLKHPEKYNKLVQEIRGAFQKQDDITFLSVARLPYSHAVLEESLRLYPPVPGYLPRKVPMGGRFH

SEQ ID NO: 43974 - protein, 162 aa, A.fumigatus
YLQANVPHKVIAGFAETGQFDKILTYSKQVGYQPDYTQLLQHIVRVNPEKGAEFAAQLANEESGALIDLDRVVDVFLSQNMIQQATSFLLDALKDNRPEHGHLQTRLLEMNLVNAPQVADAILGNEIFTHYDRPRISQLCENAGLIQRALESSPREDAHPRI

SEQ ID NO: 43975 - protein, 224 aa, A.fumigatus
KQRVRYAPYLKKLRTGEQCIDLFKHGRYLGWSGFTGVGAPKVIRNTLVDHVEKNNLQGKLRFHLFVGTSAGPEESRWAENNMILTRAPHQVGKPIAAAINDGRTQFFDKHLSMFPQDLTYGFYTKDKPNGSNLDYTIIEATAITEDGSIVPGPAVGASPEMISVSDKIIIEVNTKTPSFEGIHDIDMPVNPPFRQPYPHTSADFKIGKTAIPVDPVFTTALEGA

SEQ ID NO: 43976 - protein, 60 aa, A.fumigatus
LIAMRPSNNWDHGVDSPQYSFTNVKKMEPLVDIRIQHWIDKLNEKFAQTGEIFDFSWWAV

SEQ ID NO: 43977 - protein, 92 aa, A.fumigatus
WHVCSYMAYDIISEIGLGAPFGFVEHGQDVCGLIHGFHDGLPAYGLLARLHPFTNWMNTTFMNKYLVATPQDDSGIGVLMRFRDRLIHQRFR

SEQ ID NO: 43978 - protein, 137 aa, A.fumigatus
LYKRGRVELSWVKTRCVGTSHTNGYHMSTHPYLIQSFHPNPIFIGSEIVAQLLLHNVRKVYIVARSKSKYLRAQENWRQRHGIVLSENDDRLEFIQCDLGDIKSVKDAADEITAKTDRLDILICNAGKLSRSTAQPL

SEQ ID NO: 43979 - protein, 93 aa, A.fumigatus
SFCRLQQSKRLRSRARKLTCIAYQDVQSVCLGRNLIRCILYGFDVSQIALNEFQPVVILAENYTMALSPVLLCSEVLALASRYNVDFPNIVQE

SEQ ID NO: 43980 - protein, 96 aa, A.fumigatus
  UNSURE (1),(8),(82): Identity of amino acid sequences at the above locations are unknown.
XYGPACEXTYGPRPVMLPCIFLCLFSLCMTSLATEYYQIILAQGIGYGLGAGGIFTTCLVCVSQWFVKQRGLALGITVAGSXIGEWQTILSVSMAC

SEQ ID NO: 43981 - protein, 114 aa, A.fumigatus
SDVGLGGVIFPFFLRLVMEDVGFNGMIRYTALFLGIILVGAFFLLSARLPPKKWDSEMAWIDFRVFQNRGFAFYCLGSYLVMWGLWAPFDYLPSMAQLSGMSDSLALYLLAIVK

SEQ ID NO: 43982 - protein, 186 aa, A.fumigatus
YLNPLSQLLQFVNPTYEIIDGDSNSEYSRLEQDFFAQSQLERHSVFYNNPGQPLYLWFDFKTEDNSTYDALKPLLKPFIDNGYLAYYNMTDDKYYSGPLILTITVHLPVDKVTNDTIRYLFLDGPLDKFTIDNNNTNIDELQICSILFRVASGSLETILVSESYATSTKNDFICSSPTGAGRNRNW

SEQ ID NO: 43983 - protein, 209 aa, A.fumigatus
TIVFLSSCNSVKFYSELLNYIDLPVLDLHGKQKQQKRTNTFFEFCNAKQGILVCTDVAATGLDIPAVDWIVQFDPPDDPRDYIHRVGRTAKGTQGKGKSLMFLTPSELGFLRYLKAAKVPLNEYEFPANKIANIQSQLTKLIKTNYLLNQSAKDGYRAYLQAYASHGLKTVYQIDKLDLKKVSASLGLDQVPRVNLSIGGTKTKKQKRS

SEQ ID NO: 43984 - protein, 291 aa, A.fumigatus
  UNSURE (259): Identity of amino acid sequences at the above locations are unknown.
RNCGPSTPGVKLSYSGTKILTYASNLLDWMSKSFTKEWEELSSVPFNPSKVDLLLDPSELLKLSGPKIVFCSGIDLRSGDISAEAFQYLCNDDRTTIILTEKTTMNFASSLSSVLYTEWDSLAKKRGGGESEDGIAVPIDKNISLKNWTKEVELTGTELTEFQEKVAQKRKEKLLAKVRDQKNQNILSADTVDSEESSDDDDEGDNEAEKQKGNTSSNLLIKQYQNINVADSNVAPNEINPLATHEAFITDHIKQSLEXNLPIDLKITHKLRPRTATFPYFATAHKQKFDE

SEQ ID NO: 43985 - protein, 101 aa, A.fumigatus
STELKLLAKFIVVFSVKIIVVRSSLHKYWKASADISPLRKSIPEQNTILGPLSFNNSLGSSNKSTFEGLKGTLDNSSHSLVKLLDIQSNRLDAYVNILVPE

SEQ ID NO: 43986 - protein, 252 aa, A.fumigatus
  UNSURE (197): Identity of amino acid sequences at the above locations are unknown.
QLISIDLLSPTTMLHIEQNNLLIEKTLTERLFPNPSESSLKSLDRIVSDFDFTTFHLLTLPGEKHLLLISLSLRCWPDLVKHDVVKYLNDKYQPFNEVLTILSTNDVEQGYDYSLVLDTSTATTSSNYDEDFKLQLIKELSNLKRNAMAAPFEQAFNRYDELLKKYANANTYSEEIQQELFNEPVSVIKYRGIDECXLLKPSFDKVTVIFSTVFQDETDKIFGKVFYKNLLMLGKDQFKLLLQLYILISKHH

SEQ ID NO: 43987 - protein, 181 aa, A.fumigatus
QLTYINQPSPIANGYFAVATEIFDSSVAPHTLEHLIFMGSKKFPYKGLLDNLGNRLYSSTNAWTAVDQTVYTLRTAGWEGFKTLLPIYLDHLINPTLTDEACLTEVYHIDGKGEEKGVVFSEMQGMENQSWFILYKKMQETLYDKNSGYSSETGGLMSELRHLTSDKIRDVFTTAVEGTAL

SEQ ID NO: 43988 - protein, 177 aa, A.fumigatus
RNDTPGVFLPTTKNAETMLSLALVGCINESFIDPVILADYLLYVLNLQDPTGKLYTDYIDHPTNNVYELLESIDQKRNVLQIDKRFDECGLANHWISKWKQGKSLKYRGLFDVAAIHEINAKDFGNLTNAERERIGLSNVQQRLQERFGDDGTSTSKHRKRTAKDRECDMKNRLFKL

SEQ ID NO: 43989 - protein, 60 aa, A.fumigatus
TADPKKADTITIELQKKLDVKYKTQHKLEKKSKPFIATSKPQPNDGKFGEYFDIEDILED

SEQ ID NO: 43990 - protein, 169 aa, A.fumigatus
SISINNQRNYHSSGKWDLTLDELWAFIQTKFNQQDQLDEFQKQLIWQWLFVAEDEEGNSESAKIYVTYNDSPVTANSDNKIFVASYDDLNNIRVLPEQETQVLYLTGITNNKKFLSSFGDKPYELLQEIAIHGSKGIWAPTLIDITGQDNRSLTGRLNKLEEWRLIYRE

SEQ ID NO: 43991 - protein, 141 aa, A.fumigatus
CNEGNKYMIFHFNQKEKADSSKCNTIHVRKSIENWAIILLYILFVWYRKSELHYDHIIHTNLWGVEKNKPPFLFQTKNSIPRLLQFSIPTQPTAITQTMLYHLNILSVLSRSPSPLPQTQPQPLEQELLLSSSHPKSATRR

SEQ ID NO: 43992 - protein, 121 aa, A.fumigatus
RFSNTMSTCAEKVIDFEIKFENEDNAEKFRANLPNQPDVKPLTHVENMQTTIDRIDAQLDGLYKAMQYYKTRNNRNQATVVSTESRIYYFSIFEVLLMVGMGFLQITIVQLFFRGSRKQLV

SEQ ID NO: 43993 - protein, 95 aa, A.fumigatus
TAIFVPNKKLNTSITSILYTNPTYCHNTNNVISSKYTICIITISITTATNTTATTGTGTTAVIFSSKISNSKMINLPEESDVPVSNITLLLGNRL

SEQ ID NO: 43994 - protein, 109 aa, A.fumigatus
LYIFGYNALLKRDAMHYEKSFESKGQHHFYIVLRQTYFVVLNSTIHNIVTRIPQDILSYTIYTNNTIYKTVSSNPNKSQSFYNDKWVLISLMLGGHKTDQLSALLFTSR

SEQ ID NO: 43995 - protein, 150 aa, A.fumigatus
KLCIPETHQKKIKKYQAMKISSNLISLINKPIRIVPLMSVNKKIKLDNMVKICTHSGSFHADESLAVYLLKLLPKYSQAELVRSRNPEDWESSDIVVDVSGKYDGVKYFDHHQREFDTTFNENYKTKLSSAGLVYKHFGKVFTTGVEGPH

SEQ ID NO: 43996 - protein, 89 aa, A.fumigatus
CKTGLSLPMCRIVVAGDPRMQLSAYPIETPWVASSIEILHINTRVVWLLSHITDLEQLEKVLLNVTQQWGHGTNLSKLNVSASQSNLTF

SEQ ID NO: 43997 - protein, 63 aa, A.fumigatus
LRLLRPPVCEHRWVKRELSTNPQLILDAGGVGVLSYQHHNVDEPAIYLAGAFTVPVEEEGADI

SEQ ID NO: 43998 - protein, 200 aa, A.fumigatus
NINQCCPELKTKTPGVTQQIKWVSIMGGSFGFGNKTPYAEFHVHTDQHAAKLVIQELSNKVVYSPWNFTHKVIATSEIRKHMYDDNNEKRSSPIRNVLFRIWTFYDRVYAANGFLEGPPIHDPLAVYSLCPFFNSFERYGYTCAQKNIDIITEGVRMGESVIVEGGNTDKGVYIGEAIDNKKFWDSILLALQNADLQTKN

SEQ ID NO: 43999 - protein, 241 aa, A.fumigatus
NSFSFFVNHWFYTMSIFTTLFNVRIYYNSFIGLTLTENGLRLVPNFFGFSFGSVGAGIYMKKTGRYYKLAVLAGIFAIYGIGKIALLTPNIPTWQQFLLLIPSGLGYSCILTVTLLALIAAAPLKYQACTTSIQYTFRSTGCTLGVSAATAVFQNVLLLQLTKKINELVSDPREAAKIIAKALDSTEYVNEAPKYVREAIRASYDAGCKGAFGFAFATIVLGVISSLFMREHVLHTSINRD

SEQ ID NO: 44000 - protein, 170 aa, A.fumigatus
TNHTTASTLILPINCTNMNTFSSPPNVIREYNDSTYQLPLNSQFHQSPFLQTQSPDYVSLREEEDDNNDKNLDIMSSCIVDSVIYKSQKIAGPLLSQISNLNIQQALIIRELLFTLLGHEGHYIQYSKRYDPTSQISRIEGPDYKIAKNLDISLKVITKKLVKFGKSYSG

SEQ ID NO: 44001 - protein, 62 aa, A.fumigatus
  UNSURE (47): Identity of amino acid sequences at the above locations are unknown.
KSFIQVFDNNKFGKIVQKFCSEMKKFLSSHQQVLINVEHEFKFNKNXNLNMLGSALTSRNFQ

SEQ ID NO: 44002 - protein, 279 aa, A.fumigatus
  UNSURE (252): Identity of amino acid sequences at the above locations are unknown.
KCGSFQRRWWKKNIAMIEFPNLLIAKTATAPGAHIRLTNYSSSFIVRAFKQLIPNYHPYTLVSFPTDKYQRLIIRKSNFKLYNMRRYMIAGSYDPHLLFIGSKSSQNFSLSKLLVNAKRLLIVIGGSAISFALPILRVMNYHGIPTKIVWVIKDFRDVLVLRYFDGFIHGDDFEIFITGDSTIKEQAKTLRNAISCASNFSKKSRISSHFDIEHDETSPLLSDNNESQIPLNLENQIENVDISMNSDDEEEXERDSDCSHNGINHSRYEDFNDVDDILV

SEQ ID NO: 44003 - protein, 129 aa, A.fumigatus
WMSYNPSHEWWRIPRIWTCRTMTQSGERGSEDYDLGTDRDQRSHQRRTINWLCCSSEQGQKQNHAVHTELTIIYFQITTTMPSVSQLVSAALAAGAFTTVNAAMGPAFSTGPVASNSFIREATSTLILP

SEQ ID NO: 44004 - protein, 257 aa, A.fumigatus
VNEIFPEVTFFLLAQELPRGRTINNSITDFESSANGSTIPLTRPILSVYVFESSVCDVTNSNSNSDHTFTAEGGHSSDEMLSTTDIYNSLTSKSVSTPTETSWLNSVAGTSNMVDMRTSTGTIISFSEVATTEMISSPSDTGNPKKSSAIDYGTNSDITTLTGRYTSLRDETVSTLQEDAGIESTTVGGITKTVHTTVYVTTSPDNSITTETAVVVVVTNDSTATTYTEIIQTTVVEGKTLTTAIPILHHGRRRSAL

SEQ ID NO: 44005 - protein, 75 aa, A.fumigatus
ISLGDIVIPCGLSLDSLAMTVIVPVGIITLCVLAYAIEYMSHDPNRNRFYIILSIFAVFMTILVVSDNYLMMFIG

SEQ ID NO: 44006 - protein, 77 aa, A.fumigatus
STRITAMKSALSAILLNRMGDTFFVIALGLMINYYHAVDYDTIALVTPYMNTFLLYTLGLLLLLAATAKSAQLGLHA

SEQ ID NO: 44007 - protein, 87 aa, A.fumigatus
LMISCYLNLYSLSMMSSYDLITLINCLLKYYLLAVTLELIHIRGYYDDIYGNIFSLIIIILAGGESAIGLSILVAYYRLRGTIGHSI

SEQ ID NO: 44008 - protein, 235 aa, A.fumigatus
LLRILPAPVVKDEALTQAFRKSIGIKIKEETEIIEGEVVEIQIDRTITGGHKQGKLTIKTTDMETIYELGNKMIEGLTKEKVLAGDVISIDKASGIITKLGRSFTTARDHDAMGPETKFVQCPEGELQKRKEVVHTISLHEIDVINSRQQGFLALFSGDTGEIRPEVRDQINTKVAEWNEQGKAHIVPGVLSIDEVHMSDIECLSFINRALEDEFSPIVIMATNRGVSRLRGTDY

SEQ ID NO: 44009 - protein, 71 aa, A.fumigatus
HVNFIDRQHPRNNMCLTLFVPFGNFSIDLVTNLWSNFPSIPRKQSQESLLSRIYNINFMQRDSVDNFFSLL

SEQ ID NO: 44010 - protein, 86 aa, A.fumigatus
TSSIDNTPGTICALPCSFHSATLVLIWSRTSGLISPVSPENKAKNPCCLEFITSISCKEIVWTTSFLFCNSPSGHWTNLVSGPMAS

SEQ ID NO: 44011 - protein, 301 aa, A.fumigatus
  UNSURE (4),(13): Identity of amino acid sequences at the above locations are unknown.
LLFXGFIQVEHLXGNLKNSDVGLFEITLIGTDFTDQSQLSNNYTMMVSNDTGLYLTSQALLYSELSKSGQTNGNGGLVVKPGDKIKIQFEKNLFKSYSSSDRPIIAYYGRSADRSSLPNWIYFDGDTLTFSGTVPYVTSENAPSIDYSFSFIASDYYGFAGAEGKFKIVVGGHQLSTSMNETNIVNGTIGSKIDESIPILSDVFLDGQPISKENISDIYDQDLPNYATFDKNNFTITGTFPNTSTTDNFTIVVKDIYGNSVELPYSFDVVNSIFTIDSLKDVNATRGPYFQYFSPRPEIPL

SEQ ID NO: 44012 - protein, 303 aa, A.fumigatus
  UNSURE (263),(284),(290): Identity of amino acid sequences at the above locations are unknown.
KYLRILGGFVEKNGFLCGQSYGYLVEDDLIWTADKLTASDRKITTANLQRKSLICYLMAINKSLDESIKDVIKPVVGNLMSLFAKEMFSAVCEPMSMHAFKVQSHPRFINRVNGALFEPVSQFPAVDKTVCLKIIQQSLQLSIKSSCREWSDYYYLAKVQRKLDKPAGLVMETMASACRSAFKNKHADNIIEPHYNLVSFALKYVKSNRLDSKDALKYLIEDPLIKLEVREETDFIKLIIKALNKIDLSDKKNWQHKAKYKLXRLMQEEYHDVKRAIDSMLSLXSLKTPXKALVLIWKPEPER

SEQ ID NO: 44013 - protein, 96 aa, A.fumigatus
SDHSRQLDLIDNCNDCCIIFKQTVLSTAGNCETGSNKAPLTRLINLGCDCTLKACILIGSQTALNISLANKDIKLPTTGLITSLMDSSSDLLIAIK

SEQ ID NO: 44014 - protein, 162 aa, A.fumigatus
CLLISLSSESVCDIIHCKTLKLFDLRQFFINFQQWQRKIESKATGKKCEEKKNDGKYSLLHTNFYITTTTIMFGLGGTTPQISSQQKLQAAEAELDMVTGMFNALVSQCHTKCINKSYNEADISKQESLCLDRCVAKYFETNVQVGENMQKLGQSGQFMGRR

SEQ ID NO: 44015 - protein, 61 aa, A.fumigatus
RIFGYDKPFDLHDWLINRCGVEVEYVMDFYIGQNIQVYLDVRPTLNTLGGIKMRFGRPFGF

SEQ ID NO: 44016 - protein, 65 aa, A.fumigatus
IGLFGHLYLKSCNTSLISFVDPPLNNSPLFNLVLTAPTRIYKPNPPNNWSYFSIISGKISKFKDS

SEQ ID NO: 44017 - protein, 207 aa, A.fumigatus
RCPNRPIYLVGFYFGGALTANFLGEEGEKENSESLVKAAYTFGCPWDFVDGAYQLQNSWTGKYLLSPALAKFLAKIVTNNYKELETYAHDIVNKETLKVIKNCKTLWEFDDNVTCKTTPYKDAFEYYQELSPVKKLSQINTPLLALNSTDDPAVGVKLPILQMKANPYFCLVETDLGGHLGYVQLNGEFWCVELVEQFFQKFEELVK

SEQ ID NO: 44018 - protein, 266 aa, A.fumigatus
KTGVFGRGTVSRISIRSIHLRNTTNFVVPENYKPNRSLLKQLPWKAGLDIWWKSLSPNRLSDLQKDLVEFMLPSHLQENQRIIKEFKKTTIDDKGNYINEVGFKIINNKDKPTKHLVFIHGYGASLGCFARNFQIINKFKDTDYNYHVHFLDNLTFGLSSNPRVNNDTINYWRIPATAIVKLFDKTPTDSKKLYRKYYKLIEGYQLDPENFEKYRSYFTPILKDLENFYCSAIEKWRLNNDIDSMDYLVGHSFGGYWCGNYALKYP

SEQ ID NO: 44019 - protein, 243 aa, A.fumigatus
DTDADVDMDKPSKSELSRSAKDRQSEVIASHNMVTQFNFDDELGEWCEFKLELNGNETQKLLMVNIVEDLSRKVVVREIPHIGRCIRPEPDAKTGKRILTTEGVNFRAMWDQDDFINVNGITSNDVYAVLKTYGVEAAKNTIVNEIYRVFDTYGISVSSRPLDLIADMMTREGTYLAFNRQRIDSSTSAFMKMSYETTCQFLTKAVLDGDREEMESPSAKIVMGKLSNVGTGSFDVFAPMPRF

SEQ ID NO: 44020 - protein, 77 aa, A.fumigatus
LPDQYLYQTSPNTMLSTPPVTQNLLSSHPQNMSNRQRQNLLGRSMHSTTEIMARSQGTWFSHPQSSWRHPVPTQLSI

SEQ ID NO: 44021 - protein, 73 aa, A.fumigatus
IMFYYAKTPQDPMFKLEDPREYTEENRLKVRFDPEKYKEGHPHDELSTWDRIRLSNGYDITEEKSAWDEIRSK

SEQ ID NO: 44022 - protein, 204 aa, A.fumigatus
  UNSURE (26),(27): Identity of amino acid sequences at the above locations are unknown.
LKKSRPGTRLGVNRFIKCEKKKFSTXXLHVDTHHQAVMDAFSDSGELYTIRNQFYTNQHNKVKAYSLDEFSPENQLKVLEFQIRSTIALEQDASKMIEDGKTRFPENEPLFQLLSAWNDLKDFGVDDSTYFEDVKKASFELQAVLTALYLVKFDKDIDQAITFLSDYIDNVNSLAKYNELEPFLVLVQFHLIKGFHNGVEDPQL

SEQ ID NO: 44023 - protein, 272 aa, A.fumigatus
  UNSURE (36): Identity of amino acid sequences at the above locations are unknown.
KHRSTADSFLSQQVDEKPWVDALDNSSVQEYQGFDXTASHNIQDLARKLTHGSTNGDHHSANDLARYLSHMSDIPGVSPFNGNISHEQLDPDSENFNAKYWVKNLKKLFESDSDYYKPSKLGVAYRNLRAYGIANDSDYQPTVTNALWKFTTEAINKLKKPDDSKYFDILKSMDAIMRPGELTVVLGRPGAGCSTLLKTIAVNTYGFHIGKESQITYDGLSPHDIERHYRGDVIYSAETDVHFPHLSVGDTLEFAARLRTPSSTTGAGRSAT

SEQ ID NO: 44024 - protein, 61 aa, A.fumigatus
PSHIYTRNMKINTPPPNSFIYFYFPKNKKEYKYPIIINNFNNLKLIISSLLQSQVLRTLHV

SEQ ID NO: 44025 - protein, 76 aa, A.fumigatus
GKLFSSIYTSTSWFRIYYFYLYTFFISFYLSFLPSFLASSFVTEVNLGDPQDNQKLNNRIIQDKLLVFSRPWKIRT

SEQ ID NO: 44026 - protein, 242 aa, A.fumigatus
YGCRGVLKIQEQQQQQQQLQQLLHYQQQDFGYNGSQQSYNNNNNNNSNINTQQQHNNSSKPPQIEELVKQYKLPMKRAAQGETSDASDKPTTDTSPTSSIKSFPEISMVTDNLTNKQDFIDNFEPTQLFPNFSIPPTRAQSPTPNYEDHNDNGIGSNIYGFMNQEMTMRDIVAPSQQEQHQQFHNDVIGNGQHQHINGDNNNRDPHTPGFQTNFIDSAFNYLNLQSGIDMNEDIHSLFHMMN

SEQ ID NO: 44027 - protein, 165 aa, A.fumigatus
  UNSURE (29): Identity of amino acid sequences at the above locations are unknown.
QKSRTDTYVKRFVTFLCLLSTISLQGTTXTTTTTNTINVNKDILNGEFVIQFLESVQSGLFQQILTSFILPTSSILTNLQDKKLVNIGLSQILVTISTTSEQYAHLTPLILETLISNLNSYEGISKSSTNNNNNGISSSSSTIATTISGGQQPLISSPRRWKDPH

SEQ ID NO: 44028 - protein, 64 aa, A.fumigatus
  UNSURE (16): Identity of amino acid sequences at the above locations are unknown.
MEDVPRIFSLNLFKNXIFNWKKFLNNRDTRKLLKFDFTLYIHFWYGIFWEYLRDNKIINCYFGT

SEQ ID NO: 44029 - protein, 82 aa, A.fumigatus
TWFSTRGETSGSSSKTPALDITLSQVNNTRIKAVVKNSGTEKITFVHLNFFNDPSPVKKVSLYRNGILLPFPSMSLLPRKHR

SEQ ID NO: 44030 - protein, 185 aa, A.fumigatus
VQATEVEFTGIKQRLRSDGLSNDALTTLAPGATYEDEFDIASTANLTQGGPVTVRTQGFVPIAMNNKIAGYIPYSSNELELEVDAEKAVAVPASIKPLDRRTKITSSCTGNRATVLNTALRNAASIASKAADAASSGSSALFTEYFKSTSGNIRSAVAARLKAVPSEASMNRGGSTNYNGSDPYG

SEQ ID NO: 44031 - protein, 80 aa, A.fumigatus
MLWSLLAKMDMRHHCHHYLHFSPSFSITTHIFFIQTRFASIIKIIRFSFFKTRIKEPTFTDQTRRTFRYFRQCFIKIVKI

SEQ ID NO: 44032 - protein, 262 aa, A.fumigatus
  UNSURE (11): Identity of amino acid sequences at the above locations are unknown.
VHVFLLWIPVXSSQKIEFHNMPNGSPKHHILDEDVLLGIRYLRDGELDYHPTKPLPHQNHFKDFCIKYNKDPKLGDLNQIDKIPCEILHQFTTKSCWTHVLILFWVQFTFAFKLYATLNTFLFVFIKKFRGSPLKYLYKTIRSASFLGAFTGIHWAAFCFIRNYHPNWFGQKFWDILAPKAGYALCGTSILLEYPSRRNELSLFVLPKALGTFIDPTPTESNIATEVIAFSLSFAVLIAYARLQPSKLRGLVGKGLSYMVKH

SEQ ID NO: 44033 - protein, 98 aa, A.fumigatus
RIIVYIESNKCVSPFLTLSRNYPSCPTTNRYRLLALQTSAEIHFDGLQSSSLHCRHTFWSSEKSELLDASKYRKNDSFVHTTNSPDFLLTQCPILPTR

SEQ ID NO: 44034 - protein, 190 aa, A.fumigatus
  UNSURE (1),(2),(3),(4),(5),(6),(7),(8): Identity of amino acid sequences at the above locations are unknown.
XXXXXXXXEDEKGKQVKLQKHASEVYQGERTVKSITKFLTSRLKNYVKKFHNIRSDGIAEWLAEDIPSVLLISNANLVSPLLKSIAIDFLDRVNVGMISKFNDESHKFVIGDKEIEVPATSKSSLFYFNKEKGELVAYTKSDKLNDKIKITEWIIEQTQQQPIEGPLSKIDKKYYYKYRTGKKKIEHDEL

SEQ ID NO: 44035 - protein, 105 aa, A.fumigatus
RPVTGNITFTRKGEVKSVVFNILNVLGELDTVLAENRGYSLYAQTNHSSDIWKHPGVHFFPNSKMYVDNVANWIEAHQNGSQLKSEAPEDDIDSLLDMMDNFGKA

SEQ ID NO: 44036 - protein, 73 aa, A.fumigatus
FVRFSISHQLSLFLIKIEQARFGGSWNFNFFIANNKFMRLIIKFGYHSDVDTVKKINGYGFQQWTNQICIGNK

SEQ ID NO: 44037 - protein, 126 aa, A.fumigatus
QVMFLERETDDIIQLVQMSFCPGEGSPVGLTPSHEGSAELTNGTNKTDSTTGQQELENNLTDVVCECLGLEIQDVDADKSFWDLGAQSMDALKLQHLCEKRGVRVRLRDIFVSRSLLELATCAVII

SEQ ID NO: 44038 - protein, 120 aa, A.fumigatus
KFLEHQIVSWDFSNYFSNGIKGSWRTNDFVRLMERRMELEVVYGHSLETITTDCKPLYKRQLNEDFVSTIKNAYTKMNETFYKQGEYHLNIADNIETIVLQPFSKWCTEHEQRVKLYEST

SEQ ID NO: 44039 - protein, 164 aa, A.fumigatus
QDKLKALKNAQYLVEKLQKKYFNKCRMLEEFKSHYTEKELQEELNDLSFQKDRAAKTNTDGSKEEDDNDTADEEIYEFTHAKYDTKQMKALLKAMLTEVPMGPHKVAILGTYQNVSTGSNITKWLLENMPEFNKNLDKAEVFGQDLVRNDFVFYHGRWKEPHLR

SEQ ID NO: 44040 - protein, 252 aa, A.fumigatus
  UNSURE (71): Identity of amino acid sequences at the above locations are unknown.
TGKSTTKNKNPFDLIMSSEHSKSFDGDLTSHRSVEYYDDSMNSSGLPFNFLAPSQVRGSTFIMDSNISTIXNIKVICRFRLEIEKELQKGKLIVEFPNTQTVTLYGKDYTTHYSFDRVFSPEASQLDIYQFSIAETVDDLINGYNGTVLAYGQTGSGKSYTMLGGPQLLDPNSKGIIPRISHEIFERISANEAVSSEVEYSVCVSFMEIHMEQIRDLIDVVNNEFDHKFTIHEDKLNGIYIFTHGRWKEPRY

SEQ ID NO: 44041 - protein, 162 aa, A.fumigatus
ASADLPRRGEDVSYLKLRPDRVACQDATAQMAILQFMSAGIPQVATPSTVHCDHLIQAQVGGPKDLARAIDLNKEVYDFLSTACAKYNLGFWKPGSGIIHQIVLENYAFPGALLIGTDSHTPNAGGLGQLAIGVGGADAVDVMSGLPWELKAPKIIGVKLNG

SEQ ID NO: 44042 - protein, 84 aa, A.fumigatus
MSGWTSPKDIILKLAGITTVKGGTGSIVKYFGSGVDTFSCTGMGYICNMGAEIGATTSVFPFNDSMVDYLNATGRSDIAQFAPV

SEQ ID NO: 44043 - protein, 153 aa, A.fumigatus
  UNSURE (147): Identity of amino acid sequences at the above locations are unknown.
GKKVDELNGDIEFKGIDFTYPSRPESGIFKDLNLHIKQGENVCLVGPSGSGKSTVSQLLLRFYDPEKGTIQIGDDVITDLNLNHYRSKLGYVQQKPLLFSGTIKENILFGKEDATDEEINNALNLSYASNFVRHLPDGLDTKIGASXSTQLSG

SEQ ID NO: 44044 - protein, 95 aa, A.fumigatus
LKQRVSLARTLIRDPNILILDDATSALDSVSEEIVMLNLIQLNKNRRVTLISIAHRLSTINNSDRNIVFNQDGQIVDDCNFMNCIMIPTSFHKLL

SEQ ID NO: 44045 - protein, 146 aa, A.fumigatus
RSSFSTANFSLFKSYTSFFFLFFFLKNTLPSNMTDTPTEGASYSEQILESARRNNTELLLSIKVELNNDQEKWAELINTTKEVITDNTPLHLACQLGNWEFIDIVLDMKAFEIDPQNREGETHYMWLLNIPTTKSLNTDTLLLTIC

SEQ ID NO: 44046 - protein, 68 aa, A.fumigatus
  UNSURE (32): Identity of amino acid sequences at the above locations are unknown.
LSCWRVHSMRFLWSPTDAETLAEFEKLKVWIXTLIRLFFTLFTLILQIVSNYKKTHSFNFFRAGILNA

SEQ ID NO: 44047 - protein, 63 aa, A.fumigatus
SLGYKWCLSLILGSEHASSIWSTIKYPCSGSSLLVYLTATCNGFLLLCFADQSQTLSCPILYL

SEQ ID NO: 44048 - protein, 185 aa, A.fumigatus
DTRSGAAAGGGEDLGGVGVEDAVHDVLEEGLEAAADELDVGVSGGGEAEEEDAGDEGRDDHCAFAADVLDVDGVARQDGAWHADNGSDGVVAVGDVGGGLGGAAGVFDVLGQERVEEGVAHSDCGPAEPEDNRCWRHVSHGLSRLGRRKGGGERVGAHTRYFAFFFFSIYVYVSRYDQLLAGALL

SEQ ID NO: 44049 - protein, 160 aa, A.fumigatus
APTLSPPPFLLPSLDRPWLTCLQQRLSSGSAGPQSEWATPSSTRSCPSTSKTPAAPPRPPPTSPTATTPSLPLSACQAPSWRATPSTSSTSAAKAQWSSRPSSPASSSSASPPPLTPTSSSSAAASRPSSRTSCTASSTPTPPRSSPPPAAAPERVSQAV

SEQ ID NO: 44050 - protein, 201 aa, A.fumigatus
AMANMSPTAVILWFCWTTIGMGYPLFNAFLPQYIKNAGGSTEASTYVTYRNYAITSIVGVPGSILACYTVDIKYIGRKGTMVISTLITGVLLFCFTASTNSNVQLVCSCLEAFFQNIMYGVLYAYTPEVFPAPSRGTGTGISSCLNRIAGLCAPLVAIYGGSSNPNSPIYASGGLILASFVAMCCRPIETVFTAGLEGAAP

SEQ ID NO: 44051 - protein, 230 aa, A.fumigatus
RFNGGSTGNSSMRSWYACVNTNLAAATGGLTWMLVDWFRTGGKWSTVGLCMGAIAGLVGITPAAGYVPVYTSVIFGIVPAIICNFAVDLKDLLQIDDGMDVWALHGVGGFVGNFMTGLFAADYVAMIDGTEIDGGWMNHHWKQLGYQLARNCCIAAWSFTVTSIILLAMDRIPFLRIRLHDNEDMLGYDLAQIGEYAYYADDDPDTNPYVLEPIRSTTISQPLPHIDAVA

SEQ ID NO: 44052 - protein, 243 aa, A.fumigatus
PGIAPSRAGLIIKKPHDPAQQQQELQPQDQSQSIESIVTSCFESLQKNGFINYFGMQRFGSFSISTHEFGKFILNENWQEFVELLLSDQESVAPGSIEARKIWKQTRDPKLTLNKLPHYFVAETAVLRVLQNESPQQKDDNNTVYSSNSYLKAIQAIPKNLRMMYGHAYQAYMWNLVASKRIELYGLNLIEGDLVCEDPITNPDIVDEDVVYLNEAKVRSLTKQDIESGKYTIFDVILPSPGC

SEQ ID NO: 44053 - protein, 271 aa, A.fumigatus
  UNSURE (182): Identity of amino acid sequences at the above locations are unknown.
PSFENLNIPCIYISIQAVLSFPASGKTTGVVIDSGDGVTHVVPVYEGFALPPSIKRMDIAGRDITESLAFNIRRMTGVALQSSSELEIVRLIKEQNCFISKDPVRDEKKYGSHYSRNNPNNELMSTYKLPDGHEIQLGVERFRATEMLFNPQLIGHESPGIHELTSLAIAKTDLDLRSTLYXNIILSGGNTLLKNVGDRMLKELKDLQQPLREDRKMSMWNKNVQNDVYNTKMKVKIYCTPERKYSTWIGGSILAGVSTFKKIVGYIGKIS

SEQ ID NO: 44054 - protein, 72 aa, A.fumigatus
LPYFFSSLTGSFDMKQFCSLINLTISNSELLCNATPVILRILNAKDSVISLPAISILFIDGGNANPSYTGTT

SEQ ID NO: 44055 - protein, 73 aa, A.fumigatus
FTICFSFFFKMGSTICSNKESKINRQIHMLRRSACTSKIVLDRFFWASGVYNFVVFTTKKVTFYWIYYINQII

SEQ ID NO: 44056 - protein, 264 aa, A.fumigatus
SRSFQPRGEDMLRSTTRNTLRLATRYTKVSSSIIRHTLPTMFGSSTGGSGIRFASQLAHVKTPPNLQNEPVKNFSFKDTKDWDLLRASITKFTDEGALKVPLVVGGKKIYRDEIKTQVNPAKHSQVLADVSQATPEDIIAAIDAAKAAKAKWATTSWTDRAAIFLKAADLISTKYRYDMLAATMLGQGKNVYQAKIDCVAELIDFFKFNVKYAEEMYQQQPIQTSPGVWNRAEYKPLERFCLCCYSIQFHCHCCQFGWSSCFNG

SEQ ID NO: 44057 - protein, 77 aa, A.fumigatus
LISLNLMLNMLKKCINNNQYKLLLVFGTVLNINLWKGFVYAVTPFNFTAIAANLVGAPALMGNTVVWKTSATPALSN

SEQ ID NO: 44058 - protein, 71 aa, A.fumigatus
TKPFQRFIFSTVPNTRRSLYWLLLIHFFSIFNIKFKEINQFSNTINFCLINIFTLSQHSSSQHIISIFGRN

SEQ ID NO: 44059 - protein, 68 aa, A.fumigatus
NAIKFNEARFNAQLSYFTKSNKAKYTLTDNTITGVDEATTLKTNSLVLFENEVFLFFLLVLSSFGDLT

SEQ ID NO: 44060 - protein, 286 aa, A.fumigatus
  UNSURE (118): Identity of amino acid sequences at the above locations are unknown.
QISKITVLNPQILWRFIISLLIVTDDNHEQLCFISSSILIKLLKLVPLLLGSTCRVTNDSLETLLTALLNRLSKKCDTIIHTHITVLFPSSSDQILHQMAFEDSCLPNIDLNKSILEXTVDSQLLLEFITCTAQILSFMKSNDYDILTAFQSNYVKSPNEDKTSKKKRKTSFSNKTREFVFNVVASSTPVIVLSVNVYLALLLLVKYDNWALNLASLNLIAFYLKNLKPSQDGDKALIFRSYKKLFPRIISMLELKNDYTGCMNKKTKNPTSSASVSSPRGWKEPH

SEQ ID NO: 44061 - protein, 70 aa, A.fumigatus
RITFLSFIRTNCHCRERIVDVNDGKTTMLNKFFRFEGEGFMTCLYSWISKITKFQSTICNNEKIPHNQKC

SEQ ID NO: 44062 - protein, 141 aa, A.fumigatus
TCHKSFSFKSKKFIQHCCFSIIDIHYSLSTMTISPNKRQKRDSSSPKKHLILNAFDMMCPSLQTAGLWSHPEDKSRDYNTIEYWTNLAKLLEKGKFNALFIADVLGGYDVYNGPRNLTAAAKSGAQWPINLLPRALEGTAL

SEQ ID NO: 44063 - protein, 110 aa, A.fumigatus
NNIRSLLYFELILNLGVILLINFMCQDMLSFYVYFEISLAPLFILIGLYGANNRDKAADYILIYTLFSSLFMLLAIGTYEVLIGNTDYQAVSLVVLSTDLLLHHGAGRNR

SEQ ID NO: 44064 - protein, 260 aa, A.fumigatus
VWSFHAVVKNESINPQHRNLFAKFDFKLLASLFNSFNEFMLIDADTILMKSPEFFFNHQSYQQTGAFFFKDRSPLLKRPITDGEFLIKMGPSSIDSIMFDIPMMTQYTTHRELFKGLRLYMESGLVMIDKQRRRHFNSILMMNQLKFIHPISNSMWGDKELCWLGFAIHGDEHYKFNNHFAAAIGQLTSNQYNKDRRTPLKSKEICASHPGHISDEDDRSVLWFNSGFRFCHEANNIDYPEETRNNVILKFLNGRHPLEI

SEQ ID NO: 44065 - protein, 77 aa, A.fumigatus
HRLYIKHHFRYPLVVQSVAILYITDGLITLTVFTNVAVSTRPTLSMSGDYTNRLSIIPLYNMPYKSYYYIINDYLSR

SEQ ID NO: 44066 - protein, 145 aa, A.fumigatus
  UNSURE (97),(99): Identity of amino acid sequences at the above locations are unknown.
KISPIIDELSELFIDYPEIQIIKINGDKDGKKMSKKYVDIGYPTLLFFYDDGRKIEFDGIRDLTSVSNFIQQLSGIRLNESKSTDNHDEEEENTAKXEXPFSGSNSNVNDGDEETTHWMNLNPENLNKKFSNPQFLWFHLEHPGV

SEQ ID NO: 44067 - protein, 176 aa, A.fumigatus
  UNSURE (95): Identity of amino acid sequences at the above locations are unknown.
VMVTSSTANDNNNEDPIISKNWVWVPNQQDLFTKGYITDYLPDGKCKVNVVKGQESSHDSTIIVDQDKLENCNPVKFNKCEDMAELTHLNEPSVXYNLYLRYLDDLIYTYSGLFLVAINPYKLLTIYNQSILMKYHQYNNVTTNKNDYQSKNGSNCNYYKQRNSPPHFCAVAEIDF

SEQ ID NO: 44068 - protein, 73 aa, A.fumigatus
SPCQLLKILIPNFITLLFNINHNHNLVLITRLQQFQNYLFLNTYKSKNLTTSFINHIPSYFNTTTALVSHLII

SEQ ID NO: 44069 - protein, 65 aa, A.fumigatus
LYEFLLLSLTMYNLFYSQPHDNIQQQTTQTVNKRDKRDKRDKTSVTKRNNYSSWPPLSFQVGVND

SEQ ID NO: 44070 - protein, 69 aa, A.fumigatus
HRGSWTSAASRSTTSRISTTNGTRCTKSVVDFGSSGSRISTSTGGCTPTSNGPSSPTNIIIRKRSLYFQ

SEQ ID NO: 44071 - protein, 169 aa, A.fumigatus
KNSCSETSIPCSICWDLLKIMNNGTKQRESSKLHDTPKAQESPTIANLLNDQADTEAVGPQPPAEVQPVASVPPMAPVAPNLSLTSVAPAPESAPAQVAAPPLVMAPAAPPISSSGNAPYISNDKNWVNQFGPPTTMLQDLHQVQSQPIYLNSNFHQQHKYYPHQILLE

SEQ ID NO: 44072 - protein, 137 aa, A.fumigatus
CGSFQPRGEILLDSGTTISYFTPNIARSIIYALGGQVHYDSSGNEAYVADCKTSGTVDFQFDRNLKISVPASEFLYQLYYTNGEPYPKCEIRVRESEDNILGDNFMRSAYIVYDLDDRKISMAQVKYTSQSNIVAIN

SEQ ID NO: 44073 - protein, 268 aa, A.fumigatus
IGISTPVVNTLIVDSIPITVVTSDQHGHGHGQEHEHEHEHADVDISHIPDDYDLSQGGIIRIVKIGELDANPCRGTHLTSTAQIQSIALLHQSPIRGGHSRLYFICGGRVANHLRKEHEILKNVSTNQLSCSIDAVEEKIELLSLNDKKTNSTLNNLLKELASIEANKIFQNFNTHDNNNSKLAYVYRADLPEYLTWVHKELTTLINQDKTGDVDVSNKQTLVLLSGAAPNGGNIIISGPNAEELRVECTSKLSNFNTWCVKDLHFQR

SEQ ID NO: 44074 - protein, 274 aa, A.fumigatus
AVPSSARGEVCTANYLGSIPGPLRDRMEIIEVNGYTKNDKIEITKRHLIPAAAKKVGLDEGRVVIPDETISRLIDKYCRESGLRHIKSLINRIFSKASRKIVEELEETDVDSHNKDTVEGTLVAKESEKVISDKAKIDTENSPIEYIQSNTEVKAETTTESQQERDAERDGDEDFLKLDLPADLKIEVKPETLKDFVGPQIYIKDRLYETLNPGVATGLAYNTSGDGDALYFESILTDSISSDLGNAGLHVTGSLKDVMKDLHLLHILLPSSLW

SEQ ID NO: 44075 - protein, 68 aa, A.fumigatus
VFSINLGFVGYYFLTFFSNKSSFDCIFVVTINISFFQFFYNFSGSFTENSIDQRLDMSQTTFTTVLVN

SEQ ID NO: 44076 - protein, 97 aa, A.fumigatus
LSTSVSSNSSTIFLEALLKILLIKDLICLKPLSRQYLSINLEIVSSGITTRPSSNPTFFAAAGIKCLFVISILSFFVYPLTSIISIRSLSGPGMEPR

SEQ ID NO: 44077 - protein, 113 aa, A.fumigatus
TVSELSIAGPSLCVGAAPPNPAPWPNNLCNLTIVVWQKKKITCREKKNSPTKKKYLYYANSSPMTTPLTSPARTHARKVYSHIKAPFFISGDDLVLYKYCDQTKPFRRNRYFF

SEQ ID NO: 44078 - protein, 155 aa, A.fumigatus
YKYFFFVGEFFFSRQVIFFFCHTTMVRLQRLLGQGAGLGGAAPTQSDGPAIDNSETVYISSLALLKMLKHGRAGVPMEVMGLMLGEFVDDFTIHVHDVFAMPQSGTGVSVEAVDDVFQTKMMDMLRQTGRDQMVVGWYHSHPGFGLHHGPGRTRA

SEQ ID NO: 44079 - protein, 75 aa, A.fumigatus
KKIFPILKIGIGNLLIFIFLITNNWRTAHCHCFLQSTFKTIWIINIIIKLRVITTTDFVYVIAGKNSWGFIIAAL

SEQ ID NO: 44080 - protein, 82 aa, A.fumigatus
FFQQFFCNICTYFLTNQRDNVYSKTKKYGILGATSDFFPIEIFVDVYITIYSQGMNTAAFFNCKHFTRSLAGFVLIVQFNVV

SEQ ID NO: 44081 - protein, 230 aa, A.fumigatus
SCEMFTIEECSCIHTLAVYRYINIHKNFYREKIRGSPQNAILLCLRIDIIPLVGQKIGAYVAEELLEELDEEGELETSVSEIMNQLAASNESLEGCLPISSLLSLAIAIIDEASESSNDEAPTILTSNHIDEIGSSYDPQFDDYVNDPDGFESRLQEAMAMSSSPIISDEENENQEISNSNFQNGENFFSREEGRSIELLPSLPPPSHNTSVSTSRDTSSTTGAGRNRTC

SEQ ID NO: 44082 - protein, 189 aa, A.fumigatus
NSLKRATLNFISTIVMNHLSSVLITESNKQELPEIIGKVFEYSYDLSDTTTSKLAIVQLTNFVNVFGGSGGKLDDKEDKYSENLPPIEGIDEFLINKVINLSFELPFQKQESNLNDAQYRLIAQEIAILLKSFELKKHDEFIVVLSNYLLNMGLSQDVCNDFCLNLHNLDLKDFKKYFISVINKMKSGK

SEQ ID NO: 44083 - protein, 84 aa, A.fumigatus
IAQIRRPSSLSVKAPMRLPKSILTLIRLDKRSDIQAPVLNINLKNDRLLTPGYLFLTPYGVDLPGPYIFDISGSSPRGWKYKRA

SEQ ID NO: 44084 - protein, 280 aa, A.fumigatus
VPNGEKTITKRKVRLVGGKAVNLFLEDPVPTELRKVLTRTESPFGEFTNMTYTACTWQPDTFSAEGFTLRAAKYGRETEIVICITMYNEDEVAFARTMHGVMKHIAHLCSRHKSKIWGKDSWKKVQVIIVADGRNKVQQSVLELLTATGCYQENLARPYVNNSKVNAHLFEYTTQISIDENLKFKGDEKNLAPVQVLFCLKELNQKKINSHRWLFNAFCPVLDPNVIVLLDVGTKPDNHAIYNLWKAFDRDSNVAGAAGEIKAMKGKGWMFHHGAGRIRD

SEQ ID NO: 44085 - protein, 269 aa, A.fumigatus
  UNSURE (267): Identity of amino acid sequences at the above locations are unknown.
RSKTVKLSPLDNAVRTIAAKNDDLIQLEAFINAALKEKTDYSHYFNDLSRQLAGTVDSPVNGGVGQYRAFFSDSKYQINEESIAKTELLRNAFNDLAIILYRCLNLHGSLIGLSMKLSHQALVELFRKNFQEEIVALRLGEEATITAPSSSRVSIFHNKRANGLMTERANSISNMSGAGSTYSGSRLARSPTNASSVSSNNSSITRSGRASNTSGYPASVIQPGYTGLKGSSLKNGNGSVTSKSINGSGKTNAINTKWLYEVFSLSXII

SEQ ID NO: 44086 - protein, 275 aa, A.fumigatus
  UNSURE (40): Identity of amino acid sequences at the above locations are unknown.
ILILKSQKFLNSDYTIDVLLNRLKESLNTGEEFSKFIKKXAQIEDDHYNQLKKFAGHVRTNMKNNSRNLKNDSLQFQMDQIIQFDESLYGVGNSYVVALNTMYDELTSLIGTIGRTRKLIKDEHKRKEKDCIDAIITAEKAKTKYNHLCEDLDRLKTSDPNKKSFSLKNKSVEQQEDELSRKVDTADQEYKLKVATCKKLKDEILVIHRPNNTKKLKNLILEMDIALNLQLQKYATWNENLIMNSGVLINPLQSSKASMKSMASDLHHGAGRIRT

SEQ ID NO: 44087 - protein, 123 aa, A.fumigatus
HHAWRKNSGNGLELANHAAVPTLTTPSNNHNLSNGSDEQMQDWGSGTRTRICPIAGQEVLQPNAKLSLGKQDSGNTMRAALALLARAAEQCESLFNGMEHERAMLLQSDDKKARLSWEVCSIV

SEQ ID NO: 44088 - protein, 146 aa, A.fumigatus
RQKSDKLKGSVTWHRLGELATCIFELGLHQDSDERIDLPDFLLESRRRLFAAVYQLDKSIVTFLGRPPRISRRHSNCRLPLDISDEALTGSRELAQRSVTAEGWSCHAVYQRSAWIRVRFLISTFREEILELSLTKPSENREEQLR

SEQ ID NO: 44089 - protein, 176 aa, A.fumigatus
  UNSURE (136): Identity of amino acid sequences at the above locations are unknown.
PPYPCHPPTAILSSVLDATPCRWEGEIAALLWSQSVGSPLQILASINPAQTCIQHSCQDNLSAARPAHSLALPQNLSQIDRVLHTPFDKTTTVRTLLLNTASQRKIEDFNKKTWGWNGCSNVWVGTVIYLSSGSPXMPNPVANAVCGPQVPGTEAPDDTTDIAGLNPCLLNACCNI

SEQ ID NO: 44090 - protein, 176 aa, A.fumigatus
FSNGRMSFFWKRENPLTGPAVLTTHVLKIWSNAIYLKIFRWRSTVAAVPMSSSHSYIVVRAGCNTVQVGGGDSCSALVTKCGISAADFSKYKPGPNLYSTLVPGQPVCCSAGTLLGFAPKPKPDRSCATYTIRQDDNCANLAAQYSLTKEDRGLQQEDMGLEWLLKCLGRDSNLFK

SEQ ID NO: 44091 - protein, 65 aa, A.fumigatus
  UNSURE (39): Identity of amino acid sequences at the above locations are unknown.
HPGRARKINSLWPINPLSHSPQSTALSHYQKVKPMGARXRTPTPKNRIEGRIFFDVLCALFPTCK

SEQ ID NO: 44092 - protein, 185 aa, A.fumigatus
GGSYFQSRRVDNYYMSAPDSEHSFSRHSRPCGPIVQFSYNSLLPHSVRLKVVSCIRMMASEKAQDAIGPAAEYDPRRDSTASAAKVVHNARAATEKEQRMSLWEGIKTYPKAVGWSLLISTCIAMEGYDICLVNNFYAFPQFNRKYGELTSKGDYQVPARVSSPPTYPPFCDMCAEMALYSGKQA

SEQ ID NO: 44093 - protein, 73 aa, A.fumigatus
  UNSURE (2),(31),(33),(36),(38),(44),(47),(58): Identity of amino acid sequences at the above locations are unknown.
GXQGSYRMASDPGPARLVSAYGESDITYRGXGXGVXPXDYSAHXAYXICWLWGRIYPXWSYTQYFNVRPYGLV

SEQ ID NO: 44094 - protein, 65 aa, A.fumigatus
IVDICGALCRFVVKMKESPTLCCLKAQWWLEFTSPATDHINTGALVGVRSLQASRIIGGCGGPLG

SEQ ID NO: 44095 - protein, 69 aa, A.fumigatus
PTPPITPENEAFANAGNPNFVKEGPETNTCSPSPSPPPMQYVDSHAYNPEAAYAHQPYEQPQMSFTSSF

SEQ ID NO: 44096 - protein, 253 aa, A.fumigatus
RRTCDDSFMDPHANAVTSDFIRQKIRSIVRDGDTAEVLCPTYPFGARRPPCADGYYETFNRSNVKLVDIREDEIEVYDQGIKTASGAEYELDMIILALGFDTGTGAMNKIDIRGSQNRSLRESWTRRLETFAGVLVHGYPNMFVVCGPHLPAGNQPVSLEAFASWIGKTIEHMETNGLASIDVSNEAMDAWTTHVEQVWGGSFLAKHAHEQGSWFVGTNISPGDTANHVLFGGMATWNPGFHPGTLETGRVKL

SEQ ID NO: 44097 - protein, 60 aa, A.fumigatus
LNSVGLSKNLLRALSASSADLPELEAFPKSHIVTFKYYVGVIHFLDENYREVRRSRANLR

SEQ ID NO: 44098 - protein, 111 aa, A.fumigatus
GLTDHACRCFNGARDFGARLVALMAGWGGEVFREKHVWWIWGPWAADITGGLFGTFIYDLAIFTEAEGPINYPRRRRKRALLIKEKNQMVKLRCKRRKIRDVERAVREVEQ

SEQ ID NO: 44099 - protein, 176 aa, A.fumigatus
GRGRRNNLARSAIIILPSVAIGALYGRAFGTMFKMWQNAYPNFFFFNSCEPDVPCVTPGIYAIVGAASALGGATRMTVSIVVIMFELTGALTYVIPIMIAVMLSKWCGDIFGKRGIYESWIHLKEYPFLDHRDDTTSPDLPAHRVMTRVEDLTVIVANGHTIDSLRNLLLATSYRG

SEQ ID NO: 44100 - protein, 75 aa, A.fumigatus
SEQRAWSALSLIHRRMYPEILLNPITQSSLTILNSSGRYILIKLWNPRNDGNIDIRSIITYGFAGPRFFPAGEFR

SEQ ID NO: 44101 - protein, 197 aa, A.fumigatus
  UNSURE (3): Identity of amino acid sequences at the above locations are unknown.
ASXYARRGAFQPRGEDSILRKTYYTAIPTNPSSKHGRHRIHHSSHQPESLDWFNVLIAQTIAQYRQTAYLLKDSPTSSILNSLTAALNNPEKKPSFIDKITVTDISLGEEFPIFSNCRIIAVDDPNSDGGRLQALMDVDLSDDNLSIAVETQLLLNYPKPCSAILPVALSISVVRFSGTLCISLVPASTPPLRHSIP

SEQ ID NO: 44102 - protein, 136 aa, A.fumigatus
MSDPNIVRLLNIVHADGHKLYLVFEFLDLDLKKYMEALPVSEGGRGKALPEGSALSKNMGLGDAMVKKFMAQLVEGIRYCHSHRILHRDLKPQNLLIDRDGNLKLADFGLARAFGVPLRTYTHEVRPLGHIDCHST

SEQ ID NO: 44103 - protein, 61 aa, A.fumigatus
NTYMVLQVVTLWYRSPEILLGGRQYSTGVDMWSCGAIFAEMCTRKPLFVFTPRGWTEPRCG

SEQ ID NO: 44104 - protein, 256 aa, A.fumigatus
  UNSURE (74),(248): Identity of amino acid sequences at the above locations are unknown.
KYYPLDKNPPKPLSGGLSARETGTRRVSVGENNLRPEECLWLADLRVGSRSVIPETGYISMALEAARMMVETQXLRLLSVKDFTVHTPVPIQNDAIGTEILVTVNDIFSHDGVISALFRCEAAVSDEFVKCATAKMIMHPGDPDRALLPTQGQRALAAGPVDINGFYNSLRCVDYHCTGPFAGLTGLHRGCDLATGTVHVPSRDPDGPIILHPATLELAIQAMIAALGAPDEGLLTGALLSKTVDNSXHLRRCRTG

SEQ ID NO: 44105 - protein, 135 aa, A.fumigatus
DTTIAGRWLKYGRAAHDSHESQDNDETRADSSPGDGSTRSEQQGERQQRDGANRPNEFAAKAAAWAEQFSDTWEDIKPWARLLYKAARLYGSWSSRSSPSGFDYFADDASENISLTTSIFVQNFHFRGAGDPRMH

SEQ ID NO: 44106 - protein, 190 aa, A.fumigatus
LHHCSGKTSLIMSLFRMVELSSGSIHIDGVDITKIPRQEIRSRINGVSQSPLLIKGSIRRNMDPNGSYAEKAIIEAIKSVGLYTKIQEKGGLDTDISEVFLSQGQQQLFCLARAILRPGKVLVLDEATSKYVTTSSPPPCSWDIILTISTTASTQRQTKSCKELSERNSARTPFSPSPTHSRQFYTAALR

SEQ ID NO: 44107 - protein, 202 aa, A.fumigatus
SSVRPSQCLITPLQRQNLTDHESLPNGRAQLGKYSYRWRRHHQDSPSRDPLTHQRRFSKPAPDQRQHQTQHGPQWFLRRESHNRSHKVCRALYQDPRERRTRHRHQRGLPLARPTTALLSRASYPPAGEGPRPRRSYKQVRHDLISSTLLMGYHIDHIHNSVDAKTDEIMQRVIREKFCTHTILAVAHTLETILHSRPEVVN

SEQ ID NO: 44108 - protein, 221 aa, A.fumigatus
  UNSURE (52),(54): Identity of amino acid sequences at the above locations are unknown.
PDSTIAAADFRTDAPIGHPISMSQNAQMQQRRMSHVGSPHVQTVQPVLNHVXRXSFPPPMAPHLQPVQQSQPSPELVAGAAEESPLYVNAKQFHRILKRRVARQKLEEQLRLTSKGRKPYLHESRHNHAMRRPRGPGGRFLTADEVAAMEKKQAATAAGSGQENVDSGKPAEENPSSAPKRKSSEVNDDNANSVKKSKTGGATRPAEESERESAEPTDEDG

SEQ ID NO: 44109 - protein, 188 aa, A.fumigatus
ERALDFEKRKREVITRLREQRKDASAANLPHVSRYLAAKAALQPDVNNNNAGPAPPISETDNPSPRLNPHDPRSYLMRNKPSHDKRRLASDPAKIRRIQTNKLPFEKIPDGCELHDLCLVQSADISLISETFCNLYEHDLYIREGDNFAGFTDADLQSLSLWESQLSSLIKQQFVFTTGGRKDPRYKY

SEQ ID NO: 44110 - protein, 61 aa, A.fumigatus
NNCSLPREVYKSETLHPDTYDQKYYNAIPAIKPDAVGVRSESVHTQEVSACHRELLELDVF

SEQ ID NO: 44111 - protein, 69 aa, A.fumigatus
RSPRIGQFLFGISAAPNLLLEDVKFEKLTVASTYLLCMYAFTPDTHRIGLDSRYGVVVFLVVSVRVECL

SEQ ID NO: 44112 - protein, 89 aa, A.fumigatus
GGGTHLVRTGGCVVKTRDGLWPHTTTFETALGPLGKESGVKILALRTNKSDVCVGIPTQSKVDALNEEAPDGAWIRNGKYAIVSFSEGQ

SEQ ID NO: 44113 - protein, 150 aa, A.fumigatus
LDSLAALILERLQSVALVGDYNVDSRTPREAFLDGSKLLVTHYHDAIGSAHSEVRQTLPLIIKDEYTDALVAQPFSKLLPPVVDQCHWANNECFLDHWRAFMDRILFQQSPEQRDRLQSLPQTHVIGKYSAFSVERSHSHDALVKELDAL

SEQ ID NO: 44114 - protein, 189 aa, A.fumigatus
  UNSURE (179),(180),(181),(182),(183),(184),(185),(186),(187),(188),(189): Identity of amino acid sequences at the above locations are unknown.
EGVQFLYECVMGMRSFNGEGAILADDMGLGKTLQTITLLWTLLKQNPIHESPPVIKKALIVCPVTLINNWRKEFRKWLGNERIGVFVFDDKRKRLTDFTMGRAYSVMIVGYEKLRTVQEGLARGAGVDIIIADEGHRLKTLQNKSGQAIQSLNATKRIILSGTPIQNDLKESSRRWIFXXXXXXXXXXX

SEQ ID NO: 44115 - protein, 122 aa, A.fumigatus
  UNSURE (122): Identity of amino acid sequences at the above locations are unknown.
SYFSICRRKRPFPTTSTRTCVFTVTILQCLYKPFSSISSLSFISLHPSISNFHLRSTLQTDKRTTTTPSTTSPPMKLNAILLFSLIGLGLATPVTVDGNLTTPGDSTSLHPLATTSHPADPX

SEQ ID NO: 44116 - protein, 166 aa, A.fumigatus
TCLHRLVKINHKEIRHLYRALVRYGDINERTEDFLREARLMDRDRETIVAVLREMSDMAAQLIREDDAKMEALEKAGKMVTKKERKAVLFDFKGANRLNAHHIVDRPRDLRILRQVTSSVADVKSFRIPEATKAADYSCSWGAREDGMLCVGVARHGWGAWTQIRD

SEQ ID NO: 44117 - protein, 128 aa, A.fumigatus
  UNSURE (66): Identity of amino acid sequences at the above locations are unknown.
NQFMFVPGVERMGEKPSPIPGIPSAILGSRLQIQRICSPQRPTELQSETVNKMPAIAEGNSTTVKXVPFNKYGVPALQRKDHLEYLYDSLEDYPASFVALDASRPWMVYWALAGLCLLGEDVTRFRER

SEQ ID NO: 44118 - protein, 124 aa, A.fumigatus
DATATSKVPQVDEVAEDLSKTTLENDNTAAEEPAQSTEDVEIPETAQADDAETGGEDDDGSDSDGGWITPSNLKKRQALDESISASAAPEPKVMQVATMTTDFAVSSDKVLPRWFYILHRRHGK

SEQ ID NO: 44119 - protein, 65 aa, A.fumigatus
LFCLLFFSLSYDTLHNVITTTSPNADKSSQTTLPLLLGLTTSRLQPETSTHAPPPADVLPSQYRQ

SEQ ID NO: 44120 - protein, 93 aa, A.fumigatus
QRALRVADACMDTAVSVELFVEILNRYVYYFDQQNETVTTKYLNGLIELIHSNLQTNEDEPNPSLEGPKRHFQRTLEYIRSREYEGVVTDPRQ

SEQ ID NO: 44121 - protein, 135 aa, A.fumigatus
SGPSALQTPAWTPPSPLSYSSRSSTATSTTSTSRTKPSQPSTSTASSSSSTPTCKPTRTSRIPASRVQSVTSSVRWSISAPENTRALSPIRDSELSRRFCDLSGLEMIISCKKRESVATLFFFPPVSVSPFPGSF

SEQ ID NO: 44122 - protein, 125 aa, A.fumigatus
PWCPDFAPLLTTIGVAGHITLRDPVEPDTFWVNPFGVAFSQIKASDLIRVNHEGKVIDGGEVRLLNAAAYMIHSAIHAARPDVVCAAHSHSLHGRAFCTLGRPLDIITQDSCAFYNVRSSSRAYV

SEQ ID NO: 44123 - protein, 148 aa, A.fumigatus
TNSSHTKRNARQQQSLPSRYRDRPVVTSIPHCLLCILTINTHELHVEQINTTVITASITSGIKTSKTTPEGPPILPARPPPSTQSSLPPRLQHHGAATSRLPQDPPRLPPTHLSATGRSSPSLPPSVAASGGHKGISRLDPPVDRHTG

SEQ ID NO: 44124 - protein, 163 aa, A.fumigatus
FSSRLVNKGFGQFAAAIVALIVTAGFKESLETASSVGKCSGVCQLAVDKMWRVVIGFGAVPACIALYYRLTIPETPRYTFDVAHDIVKADEDVRAYMTGKHEGHPDEIRRQSVLQKHAGDVTPKASWADFWRHYLQWKNGSILLGTAGSWFFLDVGKSRCLPT

SEQ ID NO: 44125 - protein, 196 aa, A.fumigatus
  UNSURE (196): Identity of amino acid sequences at the above locations are unknown.
WFRCVGDYVDRGLFSVETISLLVCLKLRYPQRVHLIRGNHESRGVTQSYGFYTECARKYGNANVWHYFTDMFDFLTLSVVINDQIFCVHGGLSPSIHSIDQIKIIDRFREIPHEGPMADLVWSDPDTERDEFSLSPRGAGYTFGAQVVRKFLEVNSMSHILRAHQLCQEGYQVLYDDRLSTVWSARNYCSRFGNCX

SEQ ID NO: 44126 - protein, 274 aa, A.fumigatus
  UNSURE (259),(262): Identity of amino acid sequences at the above locations are unknown.
KRNFRSLVWGTVPGWIFHPLTGGPIGYGGYDCVRYFEPKTARPLRDVLGIPESLFMMFKTIVAFDHFFQVIKVVTYIPISGPDSELEAEYRNGQEALQQTIDLLLRPECPFPFQGPIIPNQEYTSNIGREGYERHVTRLKEHISKGDIFQTVPSQRLSRPTSLHPFNLFRHLRTVNPSPYLFYIDCEEFQLVGASPELLVKEEKGRIITHPIAGTVKRGKSPEEDDALAAELRGSLKDRAEHVMLVDLARNDVNRVCDXNPXRPGKEGNASPPP

SEQ ID NO: 44127 - protein, 83 aa, A.fumigatus
  UNSURE (60),(83): Identity of amino acid sequences at the above locations are unknown.
RITHWPDKLPEVATLPAFSQLAGSPRDGTNKVYFQIVRYLREMGYFSQDLKTAFVSNNRXSNLLRKDHWATWINWVDFFPREX

SEQ ID NO: 44128 - protein, 205 aa, A.fumigatus
  UNSURE (23): Identity of amino acid sequences at the above locations are unknown.
YDLLSRLPDQLRSDQPKTATELXYNTDKPIYQYLAETGRAAGFHKVTGTGSVVEAPGLLADYPWEEVKSETVVDVGAGVGDFIRSYLEKFPDATAAAFELPSTAEILKQRFPDDDPLTSRIVSITGGDFFQDPIPESSVYLLRWILHNWGDEDCIKLLRRIRETMVIKPGVSRVLIIESVLFDGRLGPGPRYFHHAVPGSTLRDA

SEQ ID NO: 44129 - protein, 174 aa, A.fumigatus
  UNSURE (4),(36): Identity of amino acid sequences at the above locations are unknown.
WRSXSLTSSPPSPGNGSTVESVRHCLYTIRRFLAPXYAVIPVTADMLIKEPWTLTCALLVIPGGADLGYCRSLNGTGNRRIEQFVKRGGAYLGFCAGGYYGSKRCEFEVGDKTMEVVGDRELAFFPGICRGGAFPGFVYHSEVGARAADLKVSKDVLQDGGLHQTAGRSYVREG

SEQ ID NO: 44130 - protein, 107 aa, A.fumigatus
PSRKEFTRAVEQKQIAQQDAERARFIVERAEQERQANVIRAEGEAESAEIISKAVAKAGSGLIEIRRIDATKEIAQTLANNPNVTYLPGNEGKDGGKSTSLLLGLRN

SEQ ID NO: 44131 - protein, 86 aa, A.fumigatus
CTLDFSPGDFVLHLTIRFKRLERRSVLIDTILAMMPQIKFCASPVISLLWLSKFKSTVQSYYHLIHSTLLLNTYYQVQGYRSQVSK

SEQ ID NO: 44132 - protein, 124 aa, A.fumigatus
  UNSURE (114): Identity of amino acid sequences at the above locations are unknown.
PSTAGASNGPNRASHSMGTTGQPAIIYLPAGTYLIEGSLQLYVGTVIVGNALNPPTLKASANFPNDHIVYGKEPQLGGTINFYIGFKNVIIDSTSVAAFKSITLLKWTVSQATXLTNVLFHMPD

SEQ ID NO: 44133 - protein, 150 aa, A.fumigatus
QGYRTITFPIQNKTARPWDPVTQGSTGNLTSHDRQKRASCGGPTPDNPNKFWLETITHSGESSFLDSTYKHNYKVFRNVVTDFGADNTGAKDASAAIQNAINGMPFGPGCLYRRSANRQQLGPPTAPTGLATPWAPRVNLQSSTSRPGRI

SEQ ID NO: 44134 - protein, 113 aa, A.fumigatus
RNSKMRLSSHLLIGVALQDTSGRATVLVPLTYKDHHGTPHAIHNGTTYTLSANDTSPSIIILDYGRNVEGYGTFHVSRRSGNTSVFEMSYSETEALLDMHIVRFSHTPVEDHP

SEQ ID NO: 44135 - protein, 142 aa, A.fumigatus
STAAQCRGLAEKTLNKEAACTLAPCSFNGVHQPSLEKTFAREDVYIFSYFYDRTKPLGMPDSFTLDELHQLTSTVCGGEDSWGIFAGIEGALKELRDRPEWCLDLNFMMSLLHTGYEMPLSREVKIAKKIKNRELGWCLGAR

SEQ ID NO: 44136 - protein, 92 aa, A.fumigatus
IFTTVRQLNPPAHLRLHHRRQPNNSYPTVKMENEKGEIVDLYVNTHSFAVLRLKWFYGGPGAENDFAIWDNAQEDKRQAGASFSLHHGSVAE

SEQ ID NO: 44137 - protein, 76 aa, A.fumigatus
ARLLLTLIRLFRPRAVAVRLHDWRKDIGPIEIELIPMRRSINMAGLEIRSRCETYKSLCIMGVIWSSEPMETGVRF

SEQ ID NO: 44138 - protein, 62 aa, A.fumigatus
  UNSURE (53): Identity of amino acid sequences at the above locations are unknown.
RLRIRKLTRFPVLDDNTYTNKTWAEVSGIPVPEFHVMGSQISQQMCGTISMHXKEDWALWAY

SEQ ID NO: 44139 - protein, 188 aa, A.fumigatus
  UNSURE (8),(11),(13),(14): Identity of amino acid sequences at the above locations are unknown.
RAPPRMEXLFXPXXKTNTIHRRPDQLRLLSIQEDRLRVLSRKRLARRRGPRLQEERRALRTRLAEMRTRHIEILAPVMDLPHGLGVGVSRHAILAVDGAVPPRALPQLVRDVQILVRNTIPLIMFHLRVETKVPRRGIQVRSDDVPSHASVAEMVDRREPPRQGIGRVIGCRRRDAEADALPRGRHRR

SEQ ID NO: 44140 - protein, 188 aa, A.fumigatus
  UNSURE (175),(176),(178),(181): Identity of amino acid sequences at the above locations are unknown.
SAMAAPRESIGFGITASTTYDAPYALARRFSTVDHLSNGRVGWNIVTSYLDSAARNFGLNTQVEHDERYRIADEYLHVTYKLWEGSWRDGAVNRKDGVAGYADPKAVRQVHHRGKYFNVPGPHLCEPSPQRTPFLLQAGTSSAGKAFAAQHAEAIFLNGQKPELVRPSVDSIRLXXGXEKXLHPGGGA

SEQ ID NO: 44141 - protein, 117 aa, A.fumigatus
SCAEVQRRYSGGLEAGSFGDPNCSSWYKTEDGRITDNWHSTVVDYQNELSSIRWDDYIAEGTGESLIAKKKEMHIGRVREETWISNTSLLWGVASVAVALGGYYLKGSALIRGNRVR

SEQ ID NO: 44142 - protein, 172 aa, A.fumigatus
  UNSURE (3): Identity of amino acid sequences at the above locations are unknown.
SLXGLITFCAAFWALVVKTHRSPEAQHLGLSVKMLTGDALAIAKETCKMLALSTKVYDSERLIHGGLAGSAQHDLVEKADGFAEVFPEHKYQVVEMLQQRGHLTAVTGDGVDDAPSLKKADCGMAVDGSTEAAQAAADIVFLAPGLSTIGDAIQLARQIFQRMKAYIQYRIA

SEQ ID NO: 44143 - protein, 113 aa, A.fumigatus
DQGQGRRYQQRPGQPQWNHRRPYHSQLSSERERRRHRHQSRQSSGHAAATSRRPDTCARGRPQRNHQPSQRGRAGQSRQDHRGSDARSRTPWCSGQASCRFPWRWQGHHQSTS

SEQ ID NO: 44144 - protein, 169 aa, A.fumigatus
  UNSURE (2),(4): Identity of amino acid sequences at the above locations are unknown.
LXGXTFARIFAPVVKRYRGLPENFVERYEPPAPPRPTRPSRPKKEANAATPSEPAAAETHVERLPSPGPAPESAPSLEQEPVLEPPRSPPIAVQAPAFEASSPPQPVEAQAPIPAAPPTAPSESSEPKELATKSASKPAPPPVAQKPSGSSFKDRIAAFNKPAAPPIAP

SEQ ID NO: 44145 - protein, 62 aa, A.fumigatus
FPQFALAVAPAHGENLCHVTILFDLVFVVQHYILYRDSMEGKIDRHPDLVTPLLSDPRGASA

SEQ ID NO: 44146 - protein, 130 aa, A.fumigatus
FKSIPADQLAPGIDNAQKFTSVCINTAVYLPWLVGQCRKNGVVFKRAVFKHVTEAASAHHSGKKADVVVNCTGLSSKKLGGVCDEKLYPARGQIVVVRNDPGAMFSISGCDDGAHELSSPRAEIRDGYHG

SEQ ID NO: 44147 - protein, 107 aa, A.fumigatus
VNEILIYFLHLGSTASDKQLNSIILIPGIGMLPVREWSILLRQWTAFFDSTESRVNFFTYDYQITLDNTFSFRALLDKGHDLLAALNQHQQNVRVFSNAECLRWQRG

SEQ ID NO: 44148 - protein, 213 aa, A.fumigatus
AANLKQETDHGKAGFLDTRMVDFSRPSVTSQRNRLVASEIHQVAPAVPPEDSQPGRTDNAVPGSSQNPLLFLKNPRYGLPPALVANLAALGVTSIYPWQASCLLARGLLEGERHLVYTAPTGGGKSLVADVLMLKRIIEHPSRKAILVLPYVALVQEKLKWLRRIVENVEKNVADDDDEAARLKPYYQRWKKLQKSIRGHGYFGGNKTAASGG

SEQ ID NO: 44149 - protein, 142 aa, A.fumigatus
AETCAGEEMVQVPDNETRALRMKLLAASFFALWAVGDAAPSSVSNPRVRVRNGTYVGMRNVNYQQDFFLGMPYAQQPVGNLRFRVPQSLNDSWDGERDAKKYSDICVGYGVSQHLPLWQTSGELTESSRTLFGIRCLKLVSP

SEQ ID NO: 44150 - protein, 82 aa, A.fumigatus
SDSIWYPMSEACLTINVIRGSSVDENSKLPVGVWIHGGGFYMGSGSDQRYNMSAIVANSYEIGRPYFQATKRPPITCPLFHA

SEQ ID NO: 44151 - protein, 85 aa, A.fumigatus
VCGASGTGMFQSSSTWPLFPILTWYFLCTGRTTFVNTLCGKKVLESKDADDAASAHIEEGVRIKPVTVGKLPSVLRYPEETALIS

SEQ ID NO: 44152 - protein, 60 aa, A.fumigatus
LFFSFGEIVGYLERQYDDILAEESRIKRNPRFRDNRVHVLLYFITPTVFTTGPEGPRKRI

SEQ ID NO: 44153 - protein, 64 aa, A.fumigatus
RRHLQIQLTRLPGTNPKDWKLPSWLPASNNTNTGDDIAGTVEAVGDNVFGFSKGDRVAAFHVMM

SEQ ID NO: 44154 - protein, 232 aa, A.fumigatus
TITSSRRLESVSPRRILMGIASRYAAISFPLVILAVYSIQKVYLRTSRQLRFLDLEAKAPLYSHFSDCLNGLVTLRAFGWQPALEDKNFQLLDYSQRPFYLLYAIQRWLTLTLDMVVAAIAVILIVLVVTLRGTISARDVGVALLNVILFSQSIKLLVTFWTNLENHIGSIVRIRSFTETVSSENLPTEKDDVPPNWPWGRDIQFQSVFAELRVADCLRAFNTHLTLIKDLP

SEQ ID NO: 44155 - protein, 111 aa, A.fumigatus
AMATITQVQTQETHTVLPKSLTVVPGQITVKEISNLDLPDIPLPPPSTNPSEILAQDKGTPDNHVPRDPRLIRLTGVHPFNVEPPLTALFNEGIVFTTKGKERAAQANPRP

SEQ ID NO: 44156 - protein, 216 aa, A.fumigatus
VVLYPDCTHRRKSSLVSVDDSRSRPHLDNTDERTACFVHSLIMGEWISPPSKDIRPDAKPSKAHGTTPQTTVVDDDAIKPSEAKDRKALKTTPTVVQSRHLTKKQLSDMAWNVRKLSKKLGSIKLKLTVKSVLLVTKVRDESLVVLTRKVTQWLLSKDRSTKYVVYVEKRLETHRNLERLSSFKKNLQPKAAQVLGCKHGIKRSQSNRLRSYLRRG

SEQ ID NO: 44157 - protein, 77 aa, A.fumigatus
WGVCGLFRQPGREEGITRNIYLISVCSCSTTSLAGTWIKHSHGLKDQKQKPTNSINNFFGAMSVQWVLVPSLNLQGI

SEQ ID NO: 44158 - protein, 71 aa, A.fumigatus
PYRTLAKRVFKIKNFSDVDATLFEPASCAAHGLDKIAPKMGSSVLLFGAGPTGLVCGFRSGSCDITGTDYV

SEQ ID NO: 44159 - protein, 117 aa, A.fumigatus
ILAQMLRLNGGCKVTVVAPEGLKMDLAKNLGAGDEYVDLSRKDPSAQFEKLKSDNPYGFDIVVEATGNLNILNDSINYVRRGGKLVVYGVYANKDRVSWPPAKICEFFFPLLLLSAC

SEQ ID NO: 44160 - protein, 88 aa, A.fumigatus
  UNSURE (2),(4),(8): Identity of amino acid sequences at the above locations are unknown.
GXFXLMAXRTPGEDIMQRDKKLYGEDAEEFKPERWLDAERAKRYNKYSFTFGYGARVCLGRDIAMMELYKGPLQVGTCIPRFTVGHQC

SEQ ID NO: 44161 - protein, 83 aa, A.fumigatus
ISSSPVLITIMKFTSVLASGLLATAAIAAPLPEQRLARHARPLARTAYRSSHPPYKPGTSDVFKLINTTQGRVKLQLGWVPSS

SEQ ID NO: 44162 - protein, 212 aa, A.fumigatus
  UNSURE (1),(2): Identity of amino acid sequences at the above locations are unknown.
XXELKFRVQKDGEEEYIVRSHSNYLINRSVSAEVNLDPGRYHVLVKVTAYRRDNVESTEEVVSRLAPIKREKLVQIGLSYDLAHAKGLVVETEQEKQAREERELRRRKLERRKLREETKRRLQKEWIRERKMAARKERAAARRVAMSNGSLNHKQPDKQAAEQIFPDGPVQSPADLAGASTNGFDTMPVPNSSVPTVFTRGGRACYSMQPGS

SEQ ID NO: 44163 - protein, 143 aa, A.fumigatus
QTPEALPGFWIFMYRVSPFTYWVGGMAATQLHGRAVKCSAAETAIFNPPSGLTCQEYMADYMAVAPGHLSNPNATSSCEFCSLSVADQYLASVNIYWSERWRNFGIFWAYVVFDIAVAVMLYYCFRVKKWNFSFGKRKKSKAA

SEQ ID NO: 44164 - protein, 127 aa, A.fumigatus
RFVCSLCSRRFCRQEHLKRHYRSLHTQDKPFECHECGKKFSRSDNLAQHARTHGGGSIVMGVIDTNSSNTQPAFDEPEPRALGLALYEAANAATSKSTTSESSDGTISDTSSVGGRPAKKRRRDDHV

SEQ ID NO: 44165 - protein, 156 aa, A.fumigatus
  UNSURE (5): Identity of amino acid sequences at the above locations are unknown.
RPNLXRSSPLVGRTHDCHMQRFGALNNAIIDLVEEFGLVAFETLAVEDKKSMMNLLRVIDRASGYAFGPAEGANDTIWQVAVREGLGTMDIRDVQERWLDAKDEYDAQERSELEAEAKAREQAAQPPPREDDELDADLANFRGSLPDSGVKVIRKS

SEQ ID NO: 44166 - protein, 83 aa, A.fumigatus
SSSSSLPISRSSSSITSRTEAAANLPTAAASLSSNPPTNPSKTPISSAPFSRDISLRAPRIASSSTSFIVPDTFLYPNHPQSL

SEQ ID NO: 44167 - protein, 145 aa, A.fumigatus
TMKDSNHDFRITFTPLSGSEPLKFAKSASSSSSSLGGGCAACSLAFASASSSLRSCASYSSFASSHRSWTSRISMVPSPSRTATCQMVSFAPSAGPNAYPLALSITRNKFIMLFLSSTASVSNATSPNSSTRSMMALLRAPNLCM

SEQ ID NO: 44168 - protein, 94 aa, A.fumigatus
  UNSURE (4): Identity of amino acid sequences at the above locations are unknown.
STCXIERPLQPAVKTHNNHSLSNFKNPSQRDPLVEARSTIRKNSASAPVRRRISRACDQCNQLRTKCDGQNPCAHCIGRVPNSYPNFVLRNVPY

SEQ ID NO: 44169 - protein, 147 aa, A.fumigatus
HGNYYPYKYDLGRFNTIGSISFDHPDPSIFTVLTGPSDHAGTAIADFVIFPPRWLVAENTFRPPWYHRNTMSEFMGLICGNYDAKTGGGFQPAGASLHNVMSAHGPDADAFEGASNAELKPQKVGDGSMAFMFERYVVLRYIERFKY

SEQ ID NO: 44170 - protein, 209 aa, A.fumigatus
  UNSURE (44): Identity of amino acid sequences at the above locations are unknown.
TSSKFEEVPWVWSHSGNDLGNLMKIMLCKPLPENEEDFHTLLKXFFRSLYDIKYLMKHAGRNQAVNDSPLTPAAAQILTNLGQKSGLQDIADELGVKRVGIAHQAGSDSLVTGEIYWKMRQLIFNGKIDEGKYSGQIWGLNGQMPAMTYHMQPHQTPNLNGATIYSAAGTPSTPNTGRQTPQHHGGNIGGALTPGGPGGVMGAFQTGKA

SEQ ID NO: 44171 - protein, 66 aa, A.fumigatus
  UNSURE (55): Identity of amino acid sequences at the above locations are unknown.
NRAAGANKHWVIATVLAGAPAEDYPPSRTVYAWKGTSTVILAVLGNERAFPTQVXIGRRAEDPRNR

SEQ ID NO: 44172 - protein, 142 aa, A.fumigatus
  UNSURE (12): Identity of amino acid sequences at the above locations are unknown.
WYFHTTAMFEGXPHREHVPIFKAYYLLQASYWAQQAIVLLLQLEKPRKDFKELVGHHIITLALIGLSYRFHFTYMGIAVYITHDISDFFLAVCLQGFFLLERELTDASCRPQKPSTTWTPSSLYHTLAPSSLCGSTSAISST

SEQ ID NO: 44173 - protein, 132 aa, A.fumigatus
  UNSURE (123),(124): Identity of amino acid sequences at the above locations are unknown.
TSKTLNYLDSIITVPYFGTFVLMWIYLRHFLNLKILWAVLTEFRTVGPYELNWETQQYKCWISQIITFVLLASLQAVNLFWLFLILRILKNYIFNSVKKDERSDDETEEELEHEAESRGTLAXXVQRSRIRE

SEQ ID NO: 44174 - protein, 188 aa, A.fumigatus
  UNSURE (10): Identity of amino acid sequences at the above locations are unknown.
PCWCWPCGEXFPEPEDLKEIPQKVDGAEFLVNLIDSPGHVDFSSEVTAALRVTDGALVVVDCVEGVCVQTETVLRQALTERIKPVLIINKVDRALLELQVSKEDLYQSFSRTVESVNVIIATYHDKALGDVQVYPDRGTVAFGSGLHGWAFTVRQFAVKYAKKFGVDRKKMLERLWVSGTYLFPGRKI

SEQ ID NO: 44175 - protein, 192 aa, A.fumigatus
  UNSURE (183): Identity of amino acid sequences at the above locations are unknown.
ASWLYFPSGKKICSTHPETLKHLLTVNTELLGVLDSELADGESPSVETGTESNGTAVGVDLNITKSLVVVGGDDDVNGLNGTREGLVEILLGNLKFEQSTVDLVDDQDRLDTLGQGLTQDGLGLDTDTLNAVDDDQGTVSDTESGSDLRGEVNVTGGIDQVDQELSTIDLLGDFLKILRLWEXFSTRPAPAR

SEQ ID NO: 44176 - protein, 74 aa, A.fumigatus
FLSVASIVVFCGDYASVSYLFLSSGASCPNFEFVDLLVPEASAGTCYLHNQTRECPLRQCLRQKAIPIPINSAR

SEQ ID NO: 44177 - protein, 118 aa, A.fumigatus
LSQSLPIRVFLLSNFVKDSDSPYLKCRVPLDILKTALTPLGDFPHKNEAVQFHNPILFIRALRSHYIPEASIPLISSFFPQSRIVNIDCGHWVVQERPEELRSGDVSIAYFLILKYVC

SEQ ID NO: 44178 - protein, 125 aa, A.fumigatus
  UNSURE (79): Identity of amino acid sequences at the above locations are unknown.
PNQSIETSPTTPAPSPAPSAAPSETNAASQSGSPASPPRVNPPSPVNSSNSCSATGASPPYRLDGDNIRFGLHKDLGFXRKGTQRELSGALAEVPQLLPRKAPNIANHVLLSSPVNKAEPAKNAR

SEQ ID NO: 44179 - protein, 197 aa, A.fumigatus
  UNSURE (158): Identity of amino acid sequences at the above locations are unknown.
KWHHLFFLRCSIVMISHRIHPAISAPLLYQLFRPFLHTSILHPSASHTITFSETNIQKAQSQWPRTDPSPPHSSSEPALTQPIYRNITYHASALTRSERSALRNQRGLTIWLTGLSASGKSTIAGQLEQQLLRDRGVSALPTRRRQHPLRAPQGPRFXPKRNATRTFRGIGGSTPASSPKSAKHRQSRPFILARKQG

SEQ ID NO: 44180 - protein, 157 aa, A.fumigatus
  UNSURE (55): Identity of amino acid sequences at the above locations are unknown.
SIPLSGISDIPFMRNSRRGFRSGTFLQVHYGQGHPVIRLGPNALSFAGGQAIPAXYGHDTPATKDRQYLNAAGSHFHLADVVDKKEHARKRKVLASAFAATHLEDWEYKVADKVQRLMQRFDQHLAQMPDDPLDYRSWTNLFTIDSLCDTLIVAPTV

SEQ ID NO: 44181 - protein, 191 aa, A.fumigatus
TDDNNSEDQTNEKVRKVLSGLSKSTLVVAPLALIKQWESEIATKIEDSHKLRVCVYHGNTRAKATDSLDTYDVVITTYGTLTSEYGAVDKNKKKAGLFSVYWYRIVLDEAHTIKNRNAKATQSACALDAEYRWCLSGTPMQNNLDELQSLIKFLRIKPYNDLAAWKDQITRPLSNGHAPLRFFSTGRDPLW

SEQ ID NO: 44182 - protein, 79 aa, A.fumigatus
SYIYAPSTCPLTLTSRYNQLPCPSYLFSLTCLLILPNMELSAGSSSKATQSTTSQASFNSGDVTLWVFVALERPSRSSR

SEQ ID NO: 44183 - protein, 60 aa, A.fumigatus
GSESRHVRSTLSVKNVFTIPYSRKMRSSQKSNPVLVRLHHNGSTPLGSHTFTHLPLVPLL

SEQ ID NO: 44184 - protein, 79 aa, A.fumigatus
  UNSURE (42): Identity of amino acid sequences at the above locations are unknown.
GKFREYLERTTYINQVLGTGYAPLQGFSSNLYRPYQGRAGGXKSGVLVRQRLEREGLSSATKTHNVTSPELNDAWEVVD

SEQ ID NO: 44185 - protein, 109 aa, A.fumigatus
LDAGYVEDLSKGKMLRFEESLPRLPVPSLEETGRRYLKSVHAVVSEAEYERTKKAVEAFIRPGGEGQPLQERLLARAADPKYKKWLTEWWNHAAYLGYRGPVIPYVSYF

SEQ ID NO: 44186 - protein, 72 aa, A.fumigatus
VLCYTHASIKSIVYMILIISQWRNNPKIGQKSSASYVRSTSTSSRLLTFWIICHRVVHPTPKLEILNSRKSS

SEQ ID NO: 44187 - protein, 189 aa, A.fumigatus
GAPSLWLTVLMSVRLVFQNFPTRSRKSDRHTPPRLDSLYKQMMQEIRKSEEHEPCREILNLITAIYHPIMLQELASIREILAEYPNNAKSLKEAIRLCGSLTIHKGTAFFVSAKDYLTGIVSQELFLSGIESVHHTIFLRSLSSMELTLHHDLYSLRNPGFPINKVRRPEPRSTKCCVILMHLLSQSFT

SEQ ID NO: 44188 - protein, 183 aa, A.fumigatus
WVSLAIMLADSLVSLGWLVLKPVIANAPRLKARFFSSRAGNWILAQASNNGSRHSYVRYSALSPISEESSTAAYSTHLPARHGEPEEEDDAPPSQLISTRTVVILLPLTLMLNVVCMHIVFGDVMSPLLSSLATLLAVLLSIMGVRALGETDLNPVSGISKLTQLLFSLATPGLHHAAERKEA

SEQ ID NO: 44189 - protein, 116 aa, A.fumigatus
SCRVARQALKRERDSSSCDSTAQCAISQESVWIDNGYDLNPGSSCQRNYESTRNSASIMACVRSLGLHEPSALPFLVAEDLLPPDPSENQYEWSTTVDECPNGLVDDELVWTTSCV

SEQ ID NO: 44190 - protein, 179 aa, A.fumigatus
HYMTAQNEIENAIAESQLCINAFVGPVFAVDFCYVDEDSHNLLSLVAHHLVVDIVSWRIILEDLEDFLLNPQGFVLQNSSLPFQTWCRLQDEQCESVAFENDVQLEDLPAPDLAYWGMEHRQMTYGDVICETFELDPGSTQSILLECHQSVRTEPVDLFLAALVHSFGQTFGRAYRASC

SEQ ID NO: 44191 - protein, 171 aa, A.fumigatus
IVVGVTKAVSDCFGSGGIADRMIWSNGFPFVDNKEEHVFNVPVSQAMTPDPVSLPAADFPVREAEHLLNDNKFQGFPIVEDRSSKVLIGYIGRTELRYAIDRAKSEGILAPNARCVFTKEAAEAAVARRASVSRNQLVPNTFDAIQTSLGAPFVDFSRVFTTGADGCAIGV

SEQ ID NO: 44192 - protein, 141 aa, A.fumigatus
  UNSURE (13): Identity of amino acid sequences at the above locations are unknown.
KSSRWSALLPALXTLDIVGAVLFIFGVGLIILGTAWGGSTYPWSSPEVLVPLIVGGVCFALFFVYECFLEPDRLFARMFPKQVPMLPYSMFARRDTIWLAVLEFSSGAGTDVIFCFCGQQVLMLALQLCTPSFISSVYISH

SEQ ID NO: 44193 - protein, 66 aa, A.fumigatus
CHLLLLWSTGTDAGIAAMYSVFYFIGIYFTLVEAYPASRAGINLLYYIPGLGGISHAPCFNSSIHS

SEQ ID NO: 44194 - protein, 90 aa, A.fumigatus
KTAPGAACVPVAGASPSPATLNRMPSSTPPGMSTVMVFLSRTTPLPLQVPHSEPRGTIMPAPPQASQVAATWKPPCMKCTRVPEPLHWRH

SEQ ID NO: 44195 - protein, 182 aa, A.fumigatus
AADINFEDLFGAFTGGARRSGRGRRGPFQEILVGEDIEVQTNISFMEAAKGTSKDVVITPLVECGTCRGGGLKEGAKRSQCRQCNGSGTRVHFMQGGFQVAATCDACGGAGMIVPRGSECGTCRGNGVVRDKKTITVDIPGGVEDGMRLRVAGEGDAPATGTQAAPGAVFYHRGRRIRAMRV

SEQ ID NO: 44196 - protein, 100 aa, A.fumigatus
  UNSURE (96): Identity of amino acid sequences at the above locations are unknown.
VRKYQGRAHMSNGRIDYHLHYCTIFYFMSFPHLLSLGCKYTMFLLHACTTKKESEESFQQVKCNHPLNVIKAILFFFFFFVFTRGWKDQRSHFSPXFSAS

SEQ ID NO: 44197 - protein, 167 aa, A.fumigatus
  UNSURE (135): Identity of amino acid sequences at the above locations are unknown.
VNPSVVLLRRGEDCTEVITISAAGVVFHDQLTAINIAGLLITIASIGCYNYMKISKMRSEARRGTWERSPNLDSESDDSGRARSRSRGTYHRINDPETSMVTPVSHVPTSDIPAPVDGLIGDRRSFQVRASGASXNIHGLTISTGNLSDSDTRPFSPRLAGPSPLKS

SEQ ID NO: 44198 - protein, 209 aa, A.fumigatus
  UNSURE (48),(129),(131): Identity of amino acid sequences at the above locations are unknown.
LAAEQHLTYAFCIFLRVPRSINTDDCCSVRRSSFSIFSRLVLCSTLVXGVSIIFKTPPRIFASFPAASCSPNYTHTANMSYQQERYIAELAVQRATLLTQKVFHEKAKGTVSKDDKSPVTIGDFGAQAXIXQALRKNFPNDEIVAEEEANSLREDKALSAEIWRLVKDIRLGDNESNELLGGLLPSEDAMLDIIDQGKSSPRPWKDQQL

SEQ ID NO: 44199 - protein, 62 aa, A.fumigatus
RFGFAITERTIHTSYDSVTQWYSDLPRSSDRNFNLSSAIGLQGSKTVVLKAIINYLSTSAGD

SEQ ID NO: 44200 - protein, 186 aa, A.fumigatus
GNIASVSSYSLESVFRLIPVFSPFSQSALLILKLLIPFAIISANLGILNRRLEVAPSALFMVVMSISDVMTLNFFYMVRDEGSWLDIGTTISHFLIASFLCTFVAGLEFLSEVFISGVDFGPTTKAIGASITKTVGGTAGSDVVDSQSGPEDAANSKKAEGLEGSETIRRHGGLYSPGAERTASVF

SEQ ID NO: 44201 - protein, 152 aa, A.fumigatus
PSQRHDLGPIRRRRLSGCAGSRQRTRQPTQALRQSARQLALLAKDLRLRRPRSRSHLRPACHSHRLRQCHRLPRLPEIRRRPDHPRRKPHHQRQPHLQHKLLHLGPRYRRRIPPRIPHHRRRPPQNQNPLRLRHVQHPRGRELPPLRPGQDR

SEQ ID NO: 44202 - protein, 160 aa, A.fumigatus
  UNSURE (1): Identity of amino acid sequences at the above locations are unknown.
XSPDFGGDPRNVTIWGQSAGAGSVVAQVLANGRGNQPKLFDKALVSSPFWPKTYAYDAPEAEAIYDQLVTLTGCANATDSLACLKSVDVQTIRDANLIISASHTYNTSSYTWAPVIDGEFLQESLTTAVARRKIKTHFVFGMYNTHEGENFLPSGLGKTA

SEQ ID NO: 44203 - protein, 83 aa, A.fumigatus
RGINSTPQIGAGNYWLVMYSYLNHTASEFRPLFISTRTGSAVATTIKTNSTTDPLANRRPVRSWLVFPSEHPKRSCCPSNPPY

SEQ ID NO: 44204 - protein, 113 aa, A.fumigatus
IGSLYSRMTDYTVPATEIDLAEARKTFETNFFAVISICQAFLPLLIKAKGTIVMIGSVAGVSKSTSLISHFSGFDSLPLCKDHTLCVRVGLQRLKSSATFIQRHAAGGTCSLW

SEQ ID NO: 44205 - protein, 78 aa, A.fumigatus
TSGTVTTSTYSTVSTVTLTSTSTICTACEASATPAPSFAAPVTTAPAPEDMTTTVVTYETVTTCPGAFSQRTGRSAMV

SEQ ID NO: 44206 - protein, 211 aa, A.fumigatus
  UNSURE (5),(30): Identity of amino acid sequences at the above locations are unknown.
SCLTXGRRSCENATTQAQCRSSTSRRGAIXEVRWKDHRQPVWVTKFSPSDPTSVLSASDDRTVRLWDLPSQSAARTFLGHTDYVRSGAYMPGSLAASGLVVSGSYDRTVRLWDPRVENRAAMTFKMAAPIESVLPMPTGTTLLASAENKIAVLDIVAGKPLHMIQSHHKTVTALALASNGERLLSGALDGHMNVFETTGWNLVSGSKYPPP

SEQ ID NO: 44207 - protein, 124 aa, A.fumigatus
  UNSURE (94),(120): Identity of amino acid sequences at the above locations are unknown.
TSSPPGSPRGDPTASPSDHNSPRPPSPTPPASQACTPRYARSLYAPGTSARRSGSANPTAARSGRRWRSAPRLDRSARTWSPTPAAGGPSNVLXGSPRDATSKTCTAPVSSRFHTTAARXSSMK

SEQ ID NO: 44208 - protein, 210 aa, A.fumigatus
  UNSURE (182),(207): Identity of amino acid sequences at the above locations are unknown.
RRGVLGPRHKVPPSGLKHVHVPVQRTTQQPLPIRRQRQRRHRLMVTLDHMQRLPRHNIQDRDFILRRRQQRRPRRHRQHTLNRRRHLKRHRRPVLHAGIPQPHRPIITPRDHQARRRQRARHVRPATHVVCMPQERPRGALARQIPQPHGPVVAGAQHRGWIARRELGHPHRLPVVLPTYFXDRPATRRRRPALRLCRRVFTRPPPXGQA

SEQ ID NO: 44209 - protein, 61 aa, A.fumigatus
LWIICSGFPATISRTAILFSADASSVVPVGIGNTLSIGAAILNVIAARFSTRGSHSLTVRS

SEQ ID NO: 44210 - protein, 142 aa, A.fumigatus
  UNSURE (11): Identity of amino acid sequences at the above locations are unknown.
RAQYLPVPSLXDGTLRGVLQPASSAALVGQVLLHAAQGVNGMGMGSGNGKQCQGNGAVGSRGLSATEFFTFVEGGGEFATTSGTVSGQGPYTAAGGSWSGRMIREIVKVLQWHVSKVLTLLEALQGTSPLARYKMSLHQQCM

SEQ ID NO: 44211 - protein, 79 aa, A.fumigatus
EKPQPYKITTSYPTFSSSPQLPSPEFPHSDYRNPQPPAKSNISYLPNYLPNSLLQLNPPPPCQYQPTGPRSLEPAPLNT

SEQ ID NO: 44212 - protein, 103 aa, A.fumigatus
MYDFGVRGASDVVKALALGAKFVFVGRLWVWGLSIMGEEGVRHVMKSLLADFDILMGVGGFNSIKDFDKSILGMSSSVKKGTAADHLLESYPRSYTYIPGKVL

SEQ ID NO: 44213 - protein, 169 aa, A.fumigatus
  UNSURE (3): Identity of amino acid sequences at the above locations are unknown.
GGXLKLMLYDFHPRGEDIILFSFMSLSVQGPGASPEIIHKAVYLSTVLLLYSSRFSISTVVRSHPFRSLSIYTATMQFKALATLLFAALAVANPAPAPQAGDLNALMGSIPTSVLGVLMTAIPPSVVSALANPTQAASMFQQIEQGQIPDWYNNLPDSVKAWATSAAIA

SEQ ID NO: 44214 - protein, 210 aa, A.fumigatus
  UNSURE (3),(7): Identity of amino acid sequences at the above locations are unknown.
LIXSGSXPGRCENAVNVVLTRLLDAADTLSTYSIPRRPLSSHDWGSGAGVSLDELTSQHAERAPELIHLTKSAIASELTSFDSWTERPFADEHAKRFMAEVWQSLGSIVLDAADASPNESKLAMSYVFRILARLHHSGAVSDRVYKYDPPSAHRVDFRPPGMHLLSTHIMSVLTDAAWLAHEAEVAAKAAAAGKKSPYLPFDLGIRELGH

SEQ ID NO: 44215 - protein, 214 aa, A.fumigatus
  UNSURE (176),(191),(203): Identity of amino acid sequences at the above locations are unknown.
LLVTQLRSFQAVVKTGRLVDPNTKRVYTPGMISKALDQLSSASGQQQMQQEGNGNGNGAGDENGPAQPRKPLWTGVTPNKSAKSQALEAMKALIAWQPIPVMRARMRLRVTCPVALLKQSVKAAAAPGPNKEREGPSGGAKNNKKGGKGGKGKAVRQQDSDVEAGGSDAEMAPALXAPTNVKDKIMSFIEXVESQEMVGGDEXEVVGFAEPGAF

SEQ ID NO: 44216 - protein, 84 aa, A.fumigatus
LFADLFGVTPVQSGFRGCAGPFSSPAPFPFPFPSCCICCCPLAELNWSSALEIIPGVYTRFVLGSTNLPVFTTAWKDRNCVTSK

SEQ ID NO: 44217 - protein, 85 aa, A.fumigatus
  UNSURE (1): Identity of amino acid sequences at the above locations are unknown.
XGRNEMEARARAKKESQQNNGNTPSKDDSNSKASPKGKKRKRSDSRGSGKEQDGDRDVEEENKIAKRNRIISRKRMQRKARKGKA

SEQ ID NO: 44218 - protein, 154 aa, A.fumigatus
RLPLTASLNQGPLDLRVTELPTPSPSPYKYLIEVHSAGTNFFDLLQIQGKYQHQPPLPWIGGAEFAGTILAVPTGQKKTQFKVGDRVFGATQGAYATHVLAPEASLLPIPAGWSFEDAAGLFVTAPTSYGGLVHRANVQPGDWVLVHAAAGGLG

SEQ ID NO: 44219 - protein, 78 aa, A.fumigatus
LPIVFFWCVQSFWNILKSPTRSLSRKITPWKRAMHDALLAAKQKLREYYDKTDRDHGFLYATGTMLAPQYKLWAFGDT

SEQ ID NO: 44220 - protein, 239 aa, A.fumigatus
  UNSURE (54),(61),(231): Identity of amino acid sequences at the above locations are unknown.
LTYLKLTLLVAEEAIRMYSRVLRSELFGNTVPQADLDSLSPDPLLGIPNGLNEXTRSHTPXAHTISNLPPASITPSTPHKNLFTYASPRIGSGQPTPSKTPRSQHGPNLNVRSELYSLSPIRYDSQRILETPRKQPRYVNKVPYKVLDAPDLQDDFYLNLVDWGSSNVLGVGLGNSVYMWNSNTGRVTKLCELRDDTVTSVSWIQRVMRFLYMLAMIIMCFMTEDGTGHIXYDRHQKII

SEQ ID NO: 44221 - protein, 118 aa, A.fumigatus
SMPDADDQIHPAGRHVPQTSGEPSEGLPAWIESAGPNCSIENTDIVLWHTFGLTHFPSPEDFPIMPAEPMTVLLRPRNFFARNPALDVPPSYARTPSQVAAGTNACSCKKIDGSSVQV

SEQ ID NO: 44222 - protein, 77 aa, A.fumigatus
  UNSURE (77): Identity of amino acid sequences at the above locations are unknown.
PQKDMEPGPSFRAEPMETGVCSLPYCFFFVDQKGNGCSRKKRMQETVQHELAHHWFENLLTLDFWDGLWLNEGFATX

SEQ ID NO: 44223 - protein, 316 aa, A.fumigatus
  UNSURE (28),(39),(57),(60),(71),(304),(313): Identity of amino acid sequences at the above locations are unknown.
AGASLVRKLVDIGLLGRLVAQRGICYLXVVVFLQRVLPXVKVWETYVIDSLQSALSXDSXRSSHPIEVPVXRADEINQIFDAISYSKGSSVLRMISKYLGEDVFLQGVRNYIKKHAYGNTQTGDLWSALADASGKPVEKVMDIWTKNVGFPVVSVTENPSASSIKLKQNRFLRTGDVRPEEDTTLYPVILGLRTKQGIDENTMLTEREGEFKVPDLDFYKLNADHSAIYRTSYPPERLSKLGEAAKKGLLTVEDRAGMIADAGALAASGYQSTSGLLSLLKGFDSEAEFVVWNEILTRVGTVFXRRSKGSSIXKRP

SEQ ID NO: 44224 - protein, 73 aa, A.fumigatus
WSAMVIFRDGANCLPRQRNAPYVFGIRSAACALAAGNTTVLKSSELSPCSYWAIARACCRCWPVFTRGGRGVH

SEQ ID NO: 44225 - protein, 132 aa, A.fumigatus
TTFDVISPYTNKPCWTTASATPQDAVRAVEAAENAFPAWSQTKPTVRRDILLKSADILESRLVQNAEYMRTEMGADVGASQFFIVPLGIRMLREIAGRITSICGSVPVVEEEGQSAIIYKEPMGVILGIVPW

SEQ ID NO: 44226 - protein, 155 aa, A.fumigatus
  UNSURE (148),(153): Identity of amino acid sequences at the above locations are unknown.
PFPQRDYAPDYSSIPPHGRWQHFDVGGRPRVNQLLQSWPSTIDAQERTRRLIDLFVVSVLLDAGAGTKWSYKSKESGKIYSRSEGLAVATLEMFKSGLFSSDPTEPCQVDGAGLKKITVEVLARGMQHSEHNPLAGLEGRAGRPMSLXLAPAXKV

SEQ ID NO: 44227 - protein, 301 aa, A.fumigatus
  UNSURE (8): Identity of amino acid sequences at the above locations are unknown.
PIVAAYEXIQPVAAAVSTTKLVEYIHLTGNRYIFKSNDRLYLQYCQKTGLQPHFVSNSRGLKGFWIGSPSAKYIVIYFHGMQRSKDAEKLLMIGTGGGFAMDATAPYLDFWPRIQTTLANAGIENALFHCTYTLTPHAAYPTQFCEAVEALRYILEDVGHSPSQVLLVGDSAGANLCLAVLSHLTHPSEDVPELVINEPIKGVVLMSPWVSFRHHWPSVEASEHRDIDAAEVLTEWSRAYLNGRESNNYIEAAEAPEWWWDNIRVRQTLVLAGGDEALSDPIKTWVNSFKVSSPRVLRGAR

SEQ ID NO: 44228 - protein, 198 aa, A.fumigatus
TMLPSSRLVLTADGRSAPTQTQISTGTPFWYTYSPEPYPPYTGPSQTSSPTSLIPPPPPPPGSPGSVHVTQGPPSPTPRPGNNPKNGHICTANCIPEPPCLICGCIGPGCRGGGHCIGRGCSSGGGSNGGGDDTNSCSTSHTADICTDYISSYSITGMDSSSTITQVFTLAMDTRYPFANDARLLAEPPLPARSWAQP

SEQ ID NO: 44229 - protein, 171 aa, A.fumigatus
  UNSURE (169): Identity of amino acid sequences at the above locations are unknown.
QMYHQNAMLSPLSAPVGLALQNGSILPFVGAPQEYMSTVPTNETFGSPPESSVAPSAKPASSYQRPTPRPVASHDRNGPLIVDGSIPLSEQRTLVSGEAYDQYATMSHCTSASDDRNTDTPASISDSLSQDYQDNSSVEIDQSAYFTRQTIDAPKSRHATVFTSRPEGXAI

SEQ ID NO: 44230 - protein, 183 aa, A.fumigatus
IRIARILRRLWRRPPRIKGKVILTTGVSSGSLGGFFVQSIAKAKPEWLILAARNADKLAQMAAEIAKAQPDVKVRTLKVDLGSLESVRDAAAHVNSWDDVPVIDVLVNNAGIMAVDYQLSPDGFESHLATNHLGPFLFTNLIMKKIVAAKEPKIVVVSSDGHRLNPFRFDDYNFDVGRSMALD

SEQ ID NO: 44231 - protein, 78 aa, A.fumigatus
ILCEWRPAESAIISKQGPTSPKRLDFLPPNRIASLLLYLVTMLCHCATFLVTFLEHVHHSKAVTPSDGLDNFILTVLG

SEQ ID NO: 44232 - protein, 161 aa, A.fumigatus
TFCLPTVLLRYCCISSPCFVTVPPFLSPSWNTFIIPRLSPHLMDSTTSSSRFSVSSPQSGPSAGIQKGRQRTITACLTCRRRKVKCDHAQPVCTPCQRGGRVCTYVTPQPVSQAPSRVGTGSRVSRTNLRSGQEEIRSRLERLEQPLERAFLTGRDGKVLR

SEQ ID NO: 44233 - protein, 139 aa, A.fumigatus
  UNSURE (5),(6),(7),(8),(9),(10),(11),(12),(13): Identity of amino acid sequences at the above locations are unknown.
EPDPXXXXXXXXXEDDAPLFAHFRRQFQQKSEEDQSDVCIGKLHENLRAVNNLEEASGVIYSALSGKIAAHLSVPIESIDASHPITEYGIDSHMAVELRNWIAKTMESTVPILDILASSTLLDLAGKIASKSRVVHVEE

SEQ ID NO: 44234 - protein, 64 aa, A.fumigatus
LCLCLDGGACVAMVGKDCVAIACDLRLGMQALTVSNNFPKIFNYGPSTYLGLSLHQGQEVKRSR

SEQ ID NO: 44235 - protein, 68 aa, A.fumigatus
KKKKKKKIYSFSFSSVDGLPSRFGLLFPYATQITTSAQLNSHNKEKHILRSYNTHDVYRNIGSATIVD

SEQ ID NO: 44236 - protein, 217 aa, A.fumigatus
NDVSMIQAADVGIGIVGKEGRQASLAADFSITHFHHLTKLLVWHGRNSYKRSAKLAQFIMHRGLIISACQTMYSIASHFDPKGLFINWLMVGYATVYTNAPVFSLVFDRDVDEHLANLYPELYKELKSGRSLSYRSFFGWVLVSVYQGAVIQGLSQILLNTISGPRLISVSFTALVINELLMVAIAITTWHPVMIFCLIGTALVYVFTTGLEGSAHS

SEQ ID NO: 44237 - protein, 181 aa, A.fumigatus
  UNSURE (5),(11): Identity of amino acid sequences at the above locations are unknown.
THINXLLKDLXKGASNDVNVLAWSPDGTKFAAGATAQCDEGNMEYNRGNNLVIGDLTCNRLEEVPGHYIIRPPGRAASQRALSDNRLFMSVTAMQWFDDTLFTASYDNTVKLWRFSGNHITNHKTLPHESKVLVMARSNFEKNLLATGAQSFRLWNIMESKDAPLIIESRREMTPTCLAGG

SEQ ID NO: 44238 - protein, 193 aa, A.fumigatus
PTTTPFAINHSVQRSRVICVLNKPFWFFRRGRFGRNLPILSSPSSCLFLPPLPSPSGRALPSQSNSRLIQISRCSNRVVPVLYIMQAAYHEHSSPHGEPSAYTEHMAQDQTHKAPIPKNVAFELLLDENSKVRARIPMRVQIYPHDTTDSIVTTVKNFYGIYDGAASGVSFEDENGITLIVFTARMRRHRWAS

SEQ ID NO: 44239 - protein, 181 aa, A.fumigatus
  UNSURE (3),(4),(5),(6),(7),(8),(9),(10),(11): Identity of amino acid sequences at the above locations are unknown.
DPXXXXXXXXXEDPVVPGTSVPSSTPAIPGGSSSSSEAVASSTPLVTLTLTVSPTPAPSSSESSSTDLSSSTQTDVGTAPSQPAGPSTTATATTSSSSSSTDESSTTVGSGNGNGSGSTTTTAATDSITAAPTATSSATATGATSEPVTITTVIVTSYIDICPTGFTTVTTTYTTTYCPGT

SEQ ID NO: 44240 - protein, 161 aa, A.fumigatus
  UNSURE (29),(34),(158): Identity of amino acid sequences at the above locations are unknown.
SRGPGPDVLVVALQAIREVDIESLGRAVXPGVVXGHAGPAEVHPGAVAGGLVGLAPAAGAGAEAAVGVDVGLVVHAVEAVGAVVPMEVVYRPGGDGAAIGGCDGLRKGGGGKGHKAGDEVEYGHFEGMVTYVPDRREKAGGRLIFIYSGSGEIKPGTXQTI

SEQ ID NO: 44241 - protein, 180 aa, A.fumigatus
  UNSURE (17),(141),(146): Identity of amino acid sequences at the above locations are unknown.
SPIQGQNQVIADSDRLXCPRLYFPASTVYKDQPSSRFFPSIRNICNHTFKMTILNFVTGLVAFTSTAFTQSITPPDGCPIPTWTVNNFHWYNGSHSLDCVHNQADIDAYGCLCPGTGGWCEPNQATCNGSWVHLCWTGMPXYHPWXYGPPETLDIDFTDGLQCHDEYIGSRSTASFDISR

SEQ ID NO: 44242 - protein, 114 aa, A.fumigatus
PRGPGAKGRKRQTRIVAPTMVAFSQLLLLLPIPGALASNCTPDSEAPIEATKSFDFLQHMGNTIFNTTDASLDRRDITLRTSQDGVNTVGYYYSLYNEIVLALSSPQGRRTAHG

SEQ ID NO: 44243 - protein, 130 aa, A.fumigatus
  UNSURE (112): Identity of amino acid sequences at the above locations are unknown.
QPDSAFAMTWGPMVWAIVAELFPSKYRAKGMALATASNWLWNFLLSFFTPFITGAIDFAYGYVFAGCLLVAAFVVYFCVIEGKGRTLEEIDWMYVHHVAPWKSSKFEIPQTXWEEGPGAHSRKEEQAFHA

SEQ ID NO: 44244 - protein, 129 aa, A.fumigatus
EPCSFQPCGQYRLPGAGLSNSFVTSVILGAVNFVTTFGGLYVVENFGRRKSLIFGAGFMFCMFMIFASIGHFMLDVNNPANTPEVGKGMIVLACFFIAYVPPFFFFFFFSLFLFSLSPSYTDNLIVHSQ

SEQ ID NO: 44245 - protein, 144 aa, A.fumigatus
  UNSURE (7): Identity of amino acid sequences at the above locations are unknown.
APGPSSXSVCGISNLLLFHGATWCTYIQSISSRVRPLPSITQKYTTKAATSRQPAKTYPYAKSMAPVMKGVKKLSKKFQSQLEAVARAMPLARYLEGKSSATMAQTMGPQVIANALSGCQCMMETGKKERGKKKKKKKKGGHTQ

SEQ ID NO: 44246 - protein, 119 aa, A.fumigatus
WRQGKKKEGKKKKKKKRGDIRNEEAGEDDHAFADLGSVGGVVDIKHEVADRRKDHEHAEHEAGPEDEGLAAAKVLDHVQTAKGGDEVDGAEDDRGDEAVGEPGAWKTVLTTGLEGTGLS

SEQ ID NO: 44247 - protein, 80 aa, A.fumigatus
PPARTTADFLTSICDPNARQFQPGREASTPKTPEELEAVFRNSETYKTICDEVASYDKNFRIRIRRIPAASRRTLPNVSL

SEQ ID NO: 44248 - protein, 106 aa, A.fumigatus
  UNSURE (4),(13): Identity of amino acid sequences at the above locations are unknown.
GMTXNSGRVRTTXSSGVCWDNSTRGLDASTALDYAKSLRIMTDVSKRTTFVTLYQAGESIYELMDKVLVIDSGRMLYQGPANKAREYFVNLGFHCPEKSYVSLSLT

SEQ ID NO: 44249 - protein, 156 aa, A.fumigatus
TKYYLDNQLANPLGRIFEPILGEKKANQLLTGEHTRSISVAAPTLGGLMKFAKKTQTCMGCKKPLSGKEEMAGAVCALCRPRIGELYTKTLTKVSDLEIRFGRLWTQCQRCQGSLHCEVICSSRDCPIFYMRMKAKKDVEDAQKELSRFDFDAGAW

SEQ ID NO: 44250 - protein, 195 aa, A.fumigatus
GTYLTQGRRATFANALAATTDKDTSVKGIHHEPDEIGLMTNLFLNVPALAATALDYRPHLILFNAPFAAVELIEKRITNSLQDPNLVGTVGRLQTALDEPAERGNADTSADEEHGTVGGKSLGQRIGHQATEHGNVEIQIPGIDALPLRIDDLSGEPFKISGSDSGPSTAPPVLGFRHRHCNLNESTALGILPLA

SEQ ID NO: 44251 - protein, 278 aa, A.fumigatus
  UNSURE (37),(43),(44),(52),(53),(54),(65),(71): Identity of amino acid sequences at the above locations are unknown.
APEPKGEEDTSCSFLQPRGQVLSGISARGHTSPFPQXLQAFPXXQPPVDHLXXXLHTVMPRLYSXSQDPLXSCQRQDTKCRRLIEIAVSVAETEDWRGGTRTGVGSGYLERLARQVIDAERKGIDPRNLDLHVPMFRGLMANPLAKRFASDGPMLLIGAGVGIAPFRGFVQRRLQSANCANKVWVLQGIRDSLLDELYSGEWGVEEDKVRTVVQSRRGESRYVQEEVRHQADLVWFVMNALDGRVFVCGSSKGIGEGSAAALCEISALHAGDEESVGA

SEQ ID NO: 44252 - protein, 88 aa, A.fumigatus
  UNSURE (27): Identity of amino acid sequences at the above locations are unknown.
ECLWEAPGYMLSSYPLKSWYHDIAQGXDLGGLFHDILGIQDAGVDDFLLELEWRKDSTDVEYDLVYDLYQELNARRLGMDDKTVKKIR

SEQ ID NO: 44253 - protein, 75 aa, A.fumigatus
SDIVSSHAVYNILARERPDVLKTLTQPIWYFDRKGETSKGQDEYIRTSVMYLERGENPRVYTKYGPPFLALRRMN

SEQ ID NO: 44254 - protein, 109 aa, A.fumigatus
WLLWSRWDPYYVRSLTRFSDAGIIPPLSAAQLEALQVLEDTCLQNALHMVLEVGDIQFLANSHVLHARTAYKDHAPPAPRRHLMRLWLATPEDAGGWWLLISPAWKKCI

SEQ ID NO: 44255 - protein, 65 aa, A.fumigatus
  UNSURE (33),(35),(38),(48): Identity of amino acid sequences at the above locations are unknown.
NLYLFFSSKMRGKLHIVPSMEYNPSNETRIFFXGXWVXGLACKIASRXSLSKFAILVWGKELDGN

SEQ ID NO: 44256 - protein, 284 aa, A.fumigatus
  UNSURE (18),(28),(31),(32),(273),(277),(278): Identity of amino acid sequences at the above locations are unknown.
LPSSSFPHTNMANLEREXREAILQANPXTHXXWKKILVSFEGLYSMEGTMCNLPRILELKKRYKFYFFVDEAHSIGAIGLRGRGVCDFFKVDPAEVDIFMGTFTKSFGANGGYIAADKALIKKLRATNAGQVFGEAPAPAVLAQISSSLRLIADEDPQHPGQGLERVQRLGFNSRYLRLGLKRLGFIVYGHDDSPIVPLMLYNPAKMPAFSHEMLRRKISVVVVTYPATPLELSRARLCVSAAHTKDDLDHILRVCDEIGNTLGLTYSTGGCXTRPXXARNGRG

SEQ ID NO: 44257 - protein, 238 aa, A.fumigatus
LPVGYTTVALSQTISGKLPSNLAPPPAPTNAPKNLKLLSRVNLMLSDPAQNQRLASLAQVYDLVALRPTNEKALLNACTNLECDLISLDLSVRLPFYFKFKMLSAAIERGVRLEICYGPGVTGSGLEARRNLIGNAMSLIRATRGRGIVVSSEAKRALGVRAPWDVINLTCVWGLSQELGKEAISEEARKVTALAKLKRTSWRGVIDIVDGGQMSKSQVMESGMGQKGMSKKNSRRVR

SEQ ID NO: 44258 - protein, 208 aa, A.fumigatus
  UNSURE (155),(182),(190): Identity of amino acid sequences at the above locations are unknown.
RPEKSWPTSILFIDKLRPYVKSMALRYVLVGLKQNHTLQLWDIGLGKAVQELKFPHENESDAICSVAYHAASGIIVVGHPTRNSIYFVHLSAPRYNLQPMSQASFIKRSGEKDSSLPKPESTACMSGIREISFASKGQLRSLDLLPAIKAPGDSXENSALFELYVMHSRGVTCLTIKKEDLXWGVDNKNXRPVNALEEGYIEISELQA

SEQ ID NO: 44259 - protein, 72 aa, A.fumigatus
RPSPVHSPSLTASKWWIGSLGRSAYHAVVMAQLFIAGKNYGPHPFIVQIRDLETHQPLENIYVGDIGPKFGY

SEQ ID NO: 44260 - protein, 74 aa, A.fumigatus
  UNSURE (11),(12),(13): Identity of amino acid sequences at the above locations are unknown.
IPFLEARPVQXXXGNGMCKSAIQKRISVRGSNGEKDHFRYLSVPDSELIEYAQGLLLSGYLEEAFMYVIEWEWK

SEQ ID NO: 44261 - protein, 218 aa, A.fumigatus
  UNSURE (200): Identity of amino acid sequences at the above locations are unknown.
FGVEMGGTTAVFKALWKTLWQYFAGIGIPGWQLIRQDYNLNFETYVPHSINWAWGSMVPEYDAVARKAIELIAPIPLEGSVPDATVREVIEFSNSVKRVAVDSNRFNFRWDGLLRYYDIFLNYDEKKNWKDVFSRQCKGCGAWLVCRPDWRKCYSCGKERTEEEAAIAWNPPLAVDEVKALVRASDAKPASRAAKERAVXEQLKDGTVVVSHAVEITV

SEQ ID NO: 44262 - protein, 133 aa, A.fumigatus
RWISTAGEYARFHDREGDKKTNRQTLPVIVGPRWHGALRWATALLVMGTGIMPLCITGKLVWNGQDTGFRNKRWIYTGTVITAILHVVFASLSGLRCAFSWGEAAYDRQTYKRFYMLAAYTMVCYLSFAYLTA

SEQ ID NO: 44263 - protein, 153 aa, A.fumigatus
VHVAQCCTLFLSLNVHEGHPKSMTKVIIAGVTGFVGQEVLSQCLAHPSITSIVALCRRELPTTHPKLHVHGTQERDFLSYSDPQLTASLRGAGSCIWTPGITPSRASDEQTLRPVTLELYSQAAKGFQQCLYCFQMKANKEALPGSKFPFGVC

SEQ ID NO: 44264 - protein, 202 aa, A.fumigatus
  UNSURE (5),(6),(8),(21): Identity of amino acid sequences at the above locations are unknown.
RTVFXXAXDSFVSGVVPGGFXTASTYPLDLLRTRFAAQGTERIYTSLLASVRNIARSEGPAGFFRGCSAAVGQIVPYMGLFFATYESLRPVLSGLENMPFGSGDAAAGVIASVLAKSGVFPLDLVRKRLQVQGPTRTLYVHRNIPEYRGVFSTIAMIVRTQGVRGLYRGLTVSLIKAAPASAITMWTYERSLKLLRDFRVAE

SEQ ID NO: 44265 - protein, 82 aa, A.fumigatus
LITKDCCATVGMAANRNHQYRQLGKAGRARWLNIGPTVRGVAMDAADHPHGGGRGKSKGNVDPKSPWGLPVCTCVIAGLNAL

SEQ ID NO: 44266 - protein, 96 aa, A.fumigatus
HVLLLFSSSLYSSILMFKCGGWVLRSHCIIFCLDSGARHAVFDILQTSCDYYLAVMDDRLYFHTFAMAITFMRSKYTEFTGEKDLFVYTPGWTIRR

SEQ ID NO: 44267 - protein, 139 aa, A.fumigatus
VIADQFLSLVLADISRSTGLPNFRFKLPSRNWMIFFTITGSLTAAIVYDRRERRRVQQKWCDLVAHLSKETLPIEQTRRKLTIFLSAPPGDGLRIAREHFKEYVKPILVAAALDYTVIEGRREGDVRAALVFTTAENPP

SEQ ID NO: 44268 - protein, 279 aa, A.fumigatus
  UNSURE (7),(9): Identity of amino acid sequences at the above locations are unknown.
AWIWPRXDXIYNGPERSCRAYDRDLVSVAKKRGFSYLDDRKGFDSLNGGSEAKLPLLGLFAEKDIPFEIDRRNQNDVYPSLEEMARTALKILSDATADSEQGFFLMIEGSRIDHAGHGNDPAAQVHEVIAYDKAFAAVLDFLGKDSTPGVVVSTSDHETGGLAAARQLHTSYPEYKWLPGVLANASHSTEYIDNKLREFLSTETEKNKQQHYVRELLEKGLSITDATDEEIDSILDPNSPVSSQYQLADLIIPKAQIGWSTHGPSGKFQALYHGPMEIR

SEQ ID NO: 44269 - protein, 114 aa, A.fumigatus
YRLRLGEWGFWCLGVQHRLVTLITLFALVPLLLFIVLAALIYRQAGRVWIGFSQPGICGAFHRTGARTVNKRSISPISWREHDLLPASLPKTLGLALGRRWACFHTRRLEGPTM

SEQ ID NO: 44270 - protein, 137 aa, A.fumigatus
  UNSURE (10): Identity of amino acid sequences at the above locations are unknown.
IFGPSGGLLXSRSSLCPKLGTWTSRHGRVVIVGDAAHAIPPAAGQGVNQAFEDVFTYSLMLGRSDKDALARSLKVWQTRRQERIDKVLALNTYMERRRVPSLEEEKDAEDAPLDFASLYKPDFVEIVDTWLSKHTSC

SEQ ID NO: 44271 - protein, 67 aa, A.fumigatus
IITHITWYRQSLVGSRPSGKAWGLPASRLPITTTECARSVYIAHKCSSEGAIRVYELDEKTSAFRGS

SEQ ID NO: 44272 - protein, 103 aa, A.fumigatus
LARLPGGVNIVGRDQSARNCQVAPHKCERINLFSGKPCNSVFSRPYDFTRHGDTIHYARKQKVRCHLCTEEKTFSRNDALTRHMRVVHPEVDWRGKQRRRGRD

SEQ ID NO: 44273 - protein, 62 aa, A.fumigatus
TDHETCHVISVYIHPLSTYPNTDSPTNKLNNTSQDEPAFAASQIIYRGVLRIHHSPVFVPMP

SEQ ID NO: 44274 - protein, 225 aa, A.fumigatus
  UNSURE (7): Identity of amino acid sequences at the above locations are unknown.
VAGSFSXPWREKCNCRASRSFPFVSKVMGVDLIEMATKAMIGKPFAEYPPVTIPKNYVGVKVPQFSFSRLSGADPVLGVEMASTGEVASFGRDKYEAYLKALISTGFRLPKKNVLFSIGSYKEKMEMLPSIKKLHQLGFNLFATSGTADFLKEHGVPVKYLEVLPGQEDDLKSESSLTQHLANNLIDLYINLPSNNRFRRPANYMSKSYRTRRMAVDYQTLLGTT

SEQ ID NO: 44275 - protein, 187 aa, A.fumigatus
  UNSURE (3): Identity of amino acid sequences at the above locations are unknown.
KPXKRPNPRTGADPPVVVRGALYAGGPSDSSIYQYGGTVSYTNTSFPGFQNPTSSEYALWSYNTSNGSWDQFDVTLGAEYRPAGGAYGEAPDQELAFYLNGYINNGTSNDLEDSDDLLRYLDGLIVIDTHTQMATNISTSSLANFPRVRGGMVYIPGIGPKGILVAVGGVTKSASDGSASNEGTYVG

SEQ ID NO: 44276 - protein, 187 aa, A.fumigatus
YDYARMLGPPSWMKTDTASVPMPHGAMSLGQSQTEPRTMSPKDAVLDFNETEDASMPPLFPSSQPDFNLSEALGLRRESSSSLRQAQNFPSMDSFSSQFNTQTSSLSQQYPFVQQQQNHRQPQLQQQQNNLLHHTPEFPASLPHLDSTGSEVIQNDMTSSQSNMNILPLKGEITRPDNTSTDGGTYT

SEQ ID NO: 44277 - protein, 182 aa, A.fumigatus
NKGGGVIQVSASDAVATVMIAARERRVREQALAEGLKDGTVEYEDRVMELRPRLVALGSNQAHSSTAKGALLAGTRYRSVTARLEDNMEMTGPRLREVLEQCDKDGLTPYYITLGMGTTNTCALDRFAEIKAVLKEKPHWQRIWVHIDAAYAGAALVADEWQYIAKDFAEGSSPRGWKVTRS

SEQ ID NO: 44278 - protein, 117 aa, A.fumigatus
GQSYISYLPYANKESPKINIIHAQRSIQHHFHITDNDWTLNLISPIYPSASFAILIVPYKDCCQLCRHDSERMWSRLLLANPKQLLFYHCCGKIYGTLNILRVAHTKLYSERINTHR

SEQ ID NO: 44279 - protein, 63 aa, A.fumigatus
TMIIARFFNGLSGSAFLSVAGGTVGDLFHRQELAALMMVYTASPFLVPEIGLVLHARRWKPLG

SEQ ID NO: 44280 - protein, 95 aa, A.fumigatus
TRFLPSRLEDAAVVTVKPGGMREIHWHPTSDEWAFFIRGQGRATLFSAPSTATTFDYRAGDVGYFPKSNSHYIENTGDEDLLFLEVLQADKFTGA

SEQ ID NO: 44281 - protein, 249 aa, A.fumigatus
  UNSURE (2),(20),(29),(30),(43),(46): Identity of amino acid sequences at the above locations are unknown.
TXPFPGRRPVQGRESFLALXVRMAFSQGXXREPSLFRSSHMDXVQXETLRRLWHQICHLDFRSAEGRGQEPTIADEDYTTLLPRNINDEDLIEGAHPTAETYSPPGFTDMTGHLIRLHGIHCFRRIVRSTYRLERRIKSSVANGNGNLYPIAELQSLFVEVRTMVDEMVNHLQTQYLQYCDPQIPHQRMALGLAAVIEWRCWSIFWLRTPKQYREAVVSPEIRQTYVWCCHWSRERLFSCLGAKANECV

SEQ ID NO: 44282 - protein, 77 aa, A.fumigatus
  UNSURE (39),(48): Identity of amino acid sequences at the above locations are unknown.
AILIMENIESPHSDTPQINIRTYLVILIKKTAGSHIFIXFAHLTLANXTPHIWGDFILKGRTDSESLSASDMLCVLE

SEQ ID NO: 44283 - protein, 99 aa, A.fumigatus
CFFLQCHMRPPIHAFHLLLLRSEVQASFPIECGEMTTHTLPKQRMRLVADRARTAQCMWFGIIYLALFTPHILCYSWATGAEPLASLGSDSTMAFDQKP

SEQ ID NO: 44284 - protein, 157 aa, A.fumigatus
AAQSKELNYADSIHDLAYGNVAASSVDSRGDVWLNLTGFAVNELPYIQEAVGITSLDNARELQVIAGLVSTAASQQQWGDVVFLYNVFSMNAHPEFARVVSPQMQAGLLDAVRDRASNAGPDDRLIELYASTSSSPSLVEAFRALPDLHPGAGRNRN

SEQ ID NO: 44285 - protein, 150 aa, A.fumigatus
  UNSURE (51): Identity of amino acid sequences at the above locations are unknown.
RAQHPSACRSASLASRAHCGQAHACSTGKAPASRSRAHSARLRPPQPPPLXRILSVHDSQHTLSSVFSAALSTQQSHSPQPHSYPHFPTTPAHAHRNHTHPDNTHTEPSSSQATRKCSRSYRRIPPAISPQTPPPHPHPPDPRADYPPAA

SEQ ID NO: 44286 - protein, 222 aa, A.fumigatus
GRTGSKGGRVSENLPWLDWMAKLRRRDRNSSARTHRNCNLQNMQGPVTEEIMFRSAIVLLHLLAKDTPGHIVFVAPLYFGIAHVHHFYEFRLTHPDTSIFAALFRSVFQFGYTTIFGWYATFLYLRTGSLLAVIVAHSFCNWCGLPRLWGRVEASVPIGPPVGKAKEDADVKDAHAAYGKLGLGWTVGYYVLLVSGAIAFYYALWPLSDSPNALDTFTGGSK

SEQ ID NO: 44287 - protein, 264 aa, A.fumigatus
  UNSURE (3),(4),(5),(7),(8),(9),(12),(17),(263): Identity of amino acid sequences at the above locations are unknown.
IEXXXGXXXYEXLLATXQDPSPSKSGSPRTRNKPSQSGSRSSGSVADTRGTQPGSMDMLEFLTSPEPARHDAEANTATLTSTSSPHSITFFDFVNMNNPPSMLKLTNKESIAPNALTTILFFMWGVAYGLLDILNTQFQQIVRLDSWRSLGLHAVYFGGYLVGPPLVGRTVLKRWGFKSTFITGLCIYACGTLVFWPSAVLTSYSAFTISNFIVGFGLAVLETAANPFIALCGPLENSEIRLNISQGVQAIGSVVSPLLAKKXW

SEQ ID NO: 44288 - protein, 107 aa, A.fumigatus
TNGTNSKWATAVDGLLNNTLDIFFPAKYGGNIMSEVLCEPNEVCNDNEILFKGLVTSWLAFTALLVPSTYDRILPKLQGSAVAAGATCTGNGNNSCGVRWYTSKWDG

SEQ ID NO: 44289 - protein, 65 aa, A.fumigatus
PLTYTKIKINNKTNNSPPIFTKHNHHQTKNPNYIQQPNIIHPPTYKYSIITTTNKPINFPFSIQL

SEQ ID NO: 44290 - protein, 60 aa, A.fumigatus
QEKSYPLNPSIITPLKTNSSKIKSITPLKPQLIQQLITITPGADGQFKPFRGRIVCFWGP

SEQ ID NO: 44291 - protein, 175 aa, A.fumigatus
TLLQAILGHMCPIRLRNCRLARSSQSLFSKEACPWLRSTDHVLAIFEKPVQTKEILGPNDSLRDDHRRNFFPPKKLHILLESPHRHWFRLSACRPLGWVSHLFPPSLLFRSSSEPLELPPRVFPAPSSFWLQFSPSLPPNSPPLESPLPPPHKTPPFIPPSVVMKGFPFHPTGPS

SEQ ID NO: 44292 - protein, 134 aa, A.fumigatus
EGPVGWKGNPFITTEGGIKGGVLCGGGKGDSSGGEFGGRLGENCNQKDEGAGKTRGGNSSGSEEERNRREGGKRWETHPRGRHADSRNQWRCGDSRRICSFLGGKKFLLWSSRRESFGPKISLVCTGFSNMANT

SEQ ID NO: 44293 - protein, 183 aa, A.fumigatus
  UNSURE (6): Identity of amino acid sequences at the above locations are unknown.
GRIVSXVPAEKNSLARPTLSVVQACLLLAYEQFGSNHDSGLWMYLGIAIRMAQDLGMQKLQGLQHSYGRRGVTPSAVVSGRAGQLREEEYDQSNDAQVPLSPGAEMNHSEDHRAWEREKVDTFWSIFFLDRVISSGTGRPVTLRDEEIELCFPLQSESKLSNGWPAPFPPLIRIIHLYGRVTD

SEQ ID NO: 44294 - protein, 60 aa, A.fumigatus
PNSTGSNVAIVPAASLPAYSASKAALNVFTLSLRDQLRNSNVAVIEISPPPVQSMPSQHP

SEQ ID NO: 44295 - protein, 162 aa, A.fumigatus
  UNSURE (69),(79),(100): Identity of amino acid sequences at the above locations are unknown.
DAFPVPGSEYKARGVNWVVIGDWNYVEGSSGEHAALEPRHLGGLAIITRSFARIVSLSGPHFAICVIIXTFLSQHETTXKKQGMFPLTFADPADYDKINXEDTVDILCTQLEVGKPMTLRVHPKDGSAPFDISLNHTFNESQIEWFKDGSALNTMARKSGAK

SEQ ID NO: 44296 - protein, 77 aa, A.fumigatus
LDWQRSPTGIPILYTRAGARIPPIHIFHGCPMVEVTVATLNNNLTNMWIVLVNVENGKANPFKDKFIGEVRRVPCTR

SEQ ID NO: 44297 - protein, 100 aa, A.fumigatus
PGHIIPLEAKDGGVRERKGHTEAAVEFCRLAGKSPVGVIAELVEDGDLVEGIPEIRGNNGMMRRDGCLKFGKKWGIKVCTIEDLVEYLERTESPLPNGKH

SEQ ID NO: 44298 - protein, 81 aa, A.fumigatus
ADKTPFGYNFFLLDNSHTAMSSPLPSQRHYLFMCLLLDIHGKGELTCTYSVYSNALTFLQLQSRGAELLASPFTYLGIEIM

SEQ ID NO: 44299 - protein, 87 aa, A.fumigatus
ASTFTVFQVLGGLEAMREEPSSAQLFKPLKVGRCHLQHRMIMAPTTRFRADGQGVPLPFVQEYYSQRASVPGTLLITEATSSPRAEI

SEQ ID NO: 44300 - protein, 63 aa, A.fumigatus
GIEMSDCSLSITPIIWISYIRTRGTKSLDCLVTVNGIGALGSFFAMRRASLYVSGFQYEISSQ

SEQ ID NO: 44301 - protein, 160 aa, A.fumigatus
GDFHSTGYSHEMSQSFSFESRTPHISPKSTMQGSFPGMTRKEHLSARSDEWKYGIPHWLDISYWNPETYREARRIAKKDPNAPIPFTVTKQSKLFVPRVRMYEIQMMGVMESEQSDISIPYLLEGQGVSPPLKCWSRFGPKCLSYRVPSDAIRYSPRVEI

SEQ ID NO: 44302 - protein, 110 aa, A.fumigatus
  UNSURE (47),(58),(59),(64),(91): Identity of amino acid sequences at the above locations are unknown.
IATRHTLPNWVPKTQRARPPCRPRRTGKYTSFSGGFAPTARSKTSPXAPGGAGASTIXXKDPVXRAKQKGLAGFTTAVGNKREKRSMNMYXPTQRRKTVTPAPFSWLGKN

SEQ ID NO: 44303 - protein, 77 aa, A.fumigatus
ASPKFGTFICLNCAGTHRGLGVHISFVRSITMDAFKTSEILRMENGGNDPWKTFYDNHPITQSEGRTFEDSTINERY

SEQ ID NO: 44304 - protein, 289 aa, A.fumigatus
  UNSURE (22),(23): Identity of amino acid sequences at the above locations are unknown.
YVFPKKKEVLVLEEMMKDAEGXXREPLRHYRTKTKQWFDLDDREYQRLRRSREPFLQQCFENYLLCLKESDMYNNDALRFCALWLGKSDSEIANKAVSKYLNQVPSRKFAPLMNQLTSRLQDTSDDFQNMLFALIFRICVEHPFHGMYQIFASSKSKGGKDPSALSRNRAASRLVDCLKNDKRIGPTWVAVHNANISYVRFAVDRLDEKVKSGAKVPLKKLLTGQRLEQDASTQKLPPPTMKIAIRVDCDYSEIPKLVRYHPEFTVASGVSAPKIVLHHGLEDTRTPCY

SEQ ID NO: 44305 - protein, 182 aa, A.fumigatus
  UNSURE (34): Identity of amino acid sequences at the above locations are unknown.
KKGPLLLDADLKYLYSAFTKIPCLRLAPDHRARXIRGYEEFPFDTAVPLHAFKNLSVLEIIDIDYRSFFGWDRLSEQLRTLTLKRANVEDMADLLTGIVLDDIDKRRRRSSKAQHSPVLGWNGNAHPQPVHKPDISGSVSAPGSPVVETAFGTSTSPKAVSMMRVGSEGAAPGRARTESVYL

SEQ ID NO: 44306 - protein, 113 aa, A.fumigatus
CRHLSQRHTQRMTRRLNLPDNSGILYLYIQSDRDTLHICVGRHAHIPRVIAIPRRNGIRQRIPHRVTLRILLQLPDKRNLYDNRLCRSNIPKSDGEYIRGTERMGHQRRGLAL

SEQ ID NO: 44307 - protein, 221 aa, A.fumigatus
SALLVSFGRVVKTRITGRCFYSRPGSRWSVSMARTLDGMLLQQRYPESSVTDFFASNTVILVDEAQASYKDSYFWNTIIKERRSGEGMGIKICLFCSYGSPLTGLEGDHVWFTPATFGPAQRITLTPQPGKDSPKLGLFYTPDEFDEAVSLLTTNKYDEKFTIDEEAMSYLYELTNGHPGRVTSLVDYLHSVCTVLDLSPESERIGFRLACPTNSSLGASP

SEQ ID NO: 44308 - protein, 205 aa, A.fumigatus
  UNSURE (201),(202): Identity of amino acid sequences at the above locations are unknown.
RSLQYCLTWLRWANGRLGKAIIALQGALKEWDSAKRENGEGDASLLSQRIQAVKEDVLSTLKQVVDVVSKYAGGALPENARNLVRRHLTSLPHRFQVASTSKPPPDSSASSSDATLGAHRILVLAQEGLDMMAQVSGVVNDTLVSAELWCQRLGKKRPERDSKQPDGMQPPDSHREQYPVDVKQPIREGCLHHGAGRCSLXXNSP

SEQ ID NO: 44309 - protein, 66 aa, A.fumigatus
NPSSKLLSFMDNTVGLLSVDPLIYPLLRSLTLLSVLCNAYRTAICFYYYITIIYISVGLTYSALLL

SEQ ID NO: 44310 - protein, 84 aa, A.fumigatus
IEGELFPSSRSSRPVLDQGFLHSDLTYNVPSVWDGRFFRLDDHLNGLEASCAKLRVKPLLPCEQVRQILVEIVVKTASRMPLSR

SEQ ID NO: 44311 - protein, 75 aa, A.fumigatus
ANPTETGGLFALGLGVGRSISGRLLKLSGRWKGHLYHLYHHIWKDSSAITGKSKIVTPCFPGSDNPLTTHDSTEV

SEQ ID NO: 44312 - protein, 254 aa, A.fumigatus
  UNSURE (242): Identity of amino acid sequences at the above locations are unknown.
VPGTKPQRGAFQRAGGSRSGYVGVRRKNQQSKREQQVRQYVANIQKQSTVESKKDTLSSPATDAGSGVAPSKEASTPRQPLPPKQYRLQVRLFDGSSVRNTFAPAHTIRGNVRPWLDGLLQNEKRPYNLKHILTPLPNRTLTIADEERTLEDLGLGSTANLVMIPINSYTEAYTSSGPSLPVRAAYSAYGLLSSAVGTATALVGSFIGYNPTPSDSPGSSPTSSSSPGNGGRSPQPAACTGXSPRNVGGTEVSW
